US007582441B1

(12) United States Patent
Ruben et al.

(10) Patent No.: US 7,582,441 B1
(45) Date of Patent: Sep. 1, 2009

(54) METHODS AND COMPOSITIONS FOR TREATING AND DIAGNOSING DISEASE

(75) Inventors: Steve Ruben, Brookeville, MD (US); Candy N. Lee, Bethesda, MD (US); Bruno Domon, Zurich (CH)

(73) Assignee: Celera Corporation, Alameda, CA (US)

( * ) Notice: Subject to any disclaimer, the term of this patent is extended or adjusted under 35 U.S.C. 154(b) by 106 days.

(21) Appl. No.: 11/635,029

(22) Filed: Dec. 7, 2006

Related U.S. Application Data

(63) Continuation-in-part of application No. 11/581,732, filed on Oct. 17, 2006, now abandoned.

(60) Provisional application No. 60/726,662, filed on Oct. 17, 2005, provisional application No. 60/730,005, filed on Oct. 26, 2005, provisional application No. 60/730,006, filed on Oct. 26, 2005, provisional application No. 60/730,003, filed on Oct. 26, 2005, provisional application No. 60/730,004, filed on Oct. 26, 2005, provisional application No. 60/733,167, filed on Nov. 4, 2005, provisional application No. 60/733,168, filed on Nov. 4, 2005, provisional application No. 60/734,260, filed on Nov. 8, 2005, provisional application No. 60/734,259, filed on Nov. 8, 2005, provisional application No. 60/735,857, filed on Nov. 14, 2005, provisional application No. 60/751,202, filed on Dec. 19, 2005, provisional application No. 60/751,322, filed on Dec. 19, 2005, provisional application No. 60/751,203, filed on Dec. 19, 2005, provisional application No. 60/751,323, filed on Dec. 19, 2005, provisional application No. 60/760,363, filed on Jan. 20, 2006, provisional application No. 60/818,503, filed on Jul. 6, 2006, provisional application No. 60/818,502, filed on Jul. 6, 2006, provisional application No. 60/818,499, filed on Jul. 6, 2006, provisional application No. 60/818,500, filed on Jul. 6, 2006, provisional application No. 60/819,615, filed on Jul. 11, 2006, provisional application No. 60/819,614, filed on Jul. 11, 2006, provisional application No. 60/819,613, filed on Jul. 11, 2006, provisional application No. 60/726,658, filed on Oct. 17, 2005, provisional application No. 60/734,258, filed on Nov. 8, 2005.

(51) Int. Cl.
*G01N 33/574* (2006.01)
*C07K 7/00* (2006.01)

(52) U.S. Cl. ...................... 435/7.23; 435/7.9; 435/7.91; 435/7.92; 435/7.93; 435/7.95; 435/7.94

(58) Field of Classification Search ....................... None
See application file for complete search history.

(56) References Cited

U.S. PATENT DOCUMENTS

| | | | | |
|---|---|---|---|---|
| 6,974,667 | B2 | 12/2005 | Horne et al. | |
| 7,171,311 | B2 | 1/2007 | Dai et al. | |
| 2004/0166527 | A1 * | 8/2004 | Beaudry et al. | 435/6 |

OTHER PUBLICATIONS

U.S. Appl. No. 11/606,946, filed Dec. 1, 2006, Applara Corporation.

* cited by examiner

*Primary Examiner*—Sheela J Huff

(57) ABSTRACT

Methods and compositions for diagnosing and treating diseases, particularly cancer, associated with differential expression of cancer-associated targets (CAT) in disease cells compared to healthy cells are provided. Also provided are antagonists and agonists of CAT, and methods for screening agents that modulate CAT level or activity in vivo or in vitro.

3 Claims, 213 Drawing Sheets

FIGURE 1

GFRa1 is Over-Expressed in Breast and Renal Cancer

| | Overexpression Δ+1 (% tumors) | Overexpression Δ+2 (% tumors) |
|---|---|---|
| Breast | 17% | 9% |
| Renal | 10% | 10% |

FIGURE 2
Prevalence of GFRa1 (04-0019)

| Breast Cancer Patient ID | 04-0019 | | Erb2 Her2/neu |
|---|---|---|---|
| 33263 | 0 | 0 | 1 |
| 33270 | 2 | $1^{<1\%}$ | 3 |
| 32908 | 0 | $3^{<1\%}$ | |
| 31653 | $3^{1-25\%}$ | | |
| 32928 | | | 1 |
| 33268 | 0 | $3^{1-25\%}$ | 2 |
| 33261 | $2^{<1\%}$ | $3^{1-25\%}$ | |
| 26249 | | | 1-2 |
| 33691 | 0 | $3^{<1\%}$ | 0-1 |
| 32997 | 0 | | $1^{1-25\%}$ |
| 32758 | | $3^{>50\%}$ | 0 |
| 32756 | | | 1 |

Pathologist grading scale 1 2 3

- Both anti-GFRa1 antibodies displayed similar levels of staining in breast tissues
- Both GFRa1 and erbB2 are found to be expressed in ~20% of breast cancer patients

FIGURE 3

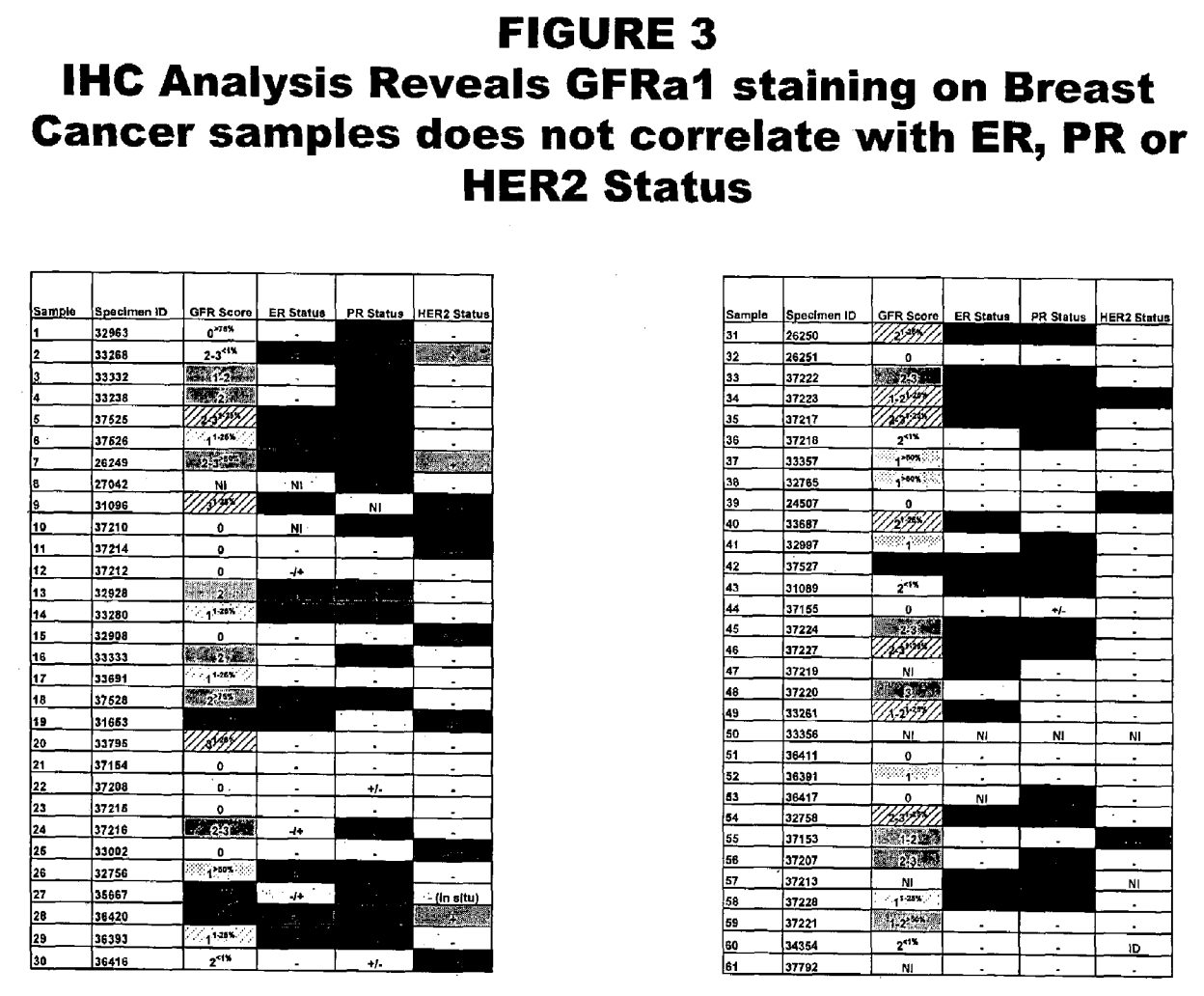

IHC Analysis Reveals GFRa1 staining on Breast Cancer samples does not correlate with ER, PR or HER2 Status

| Sample | Specimen ID | GFR Score | ER Status | PR Status | HER2 Status |
|---|---|---|---|---|---|
| 1 | 32963 | $0^{>75\%}$ | - | | - |
| 2 | 33268 | $2\text{-}3^{<1\%}$ | | | + |
| 3 | 33332 | 1-2 | - | | - |
| 4 | 33238 | 2 | - | | - |
| 5 | 37525 | $2\text{-}3^{>75\%}$ | | | - |
| 6 | 37526 | $1^{1\text{-}25\%}$ | | | - |
| 7 | 26249 | $2\text{-}3^{>50\%}$ | | | + |
| 8 | 27042 | NI | NI | | - |
| 9 | 31096 | $3^{1\text{-}25\%}$ | | NI | |
| 10 | 37210 | 0 | NI | | |
| 11 | 37214 | 0 | - | - | |
| 12 | 37212 | 0 | -/+ | - | - |
| 13 | 32928 | 2 | | | - |
| 14 | 33280 | $1^{1\text{-}25\%}$ | | | - |
| 15 | 32908 | 0 | - | - | |
| 16 | 33333 | 2 | - | | - |
| 17 | 33691 | $1^{1\text{-}25\%}$ | - | - | - |
| 18 | 37528 | $2^{>75\%}$ | | | - |
| 19 | 31653 | | | - | |
| 20 | 33795 | $3^{1\text{-}25\%}$ | - | - | - |
| 21 | 37154 | 0 | - | - | - |
| 22 | 37208 | 0 | - | +/- | - |
| 23 | 37215 | 0 | - | - | - |
| 24 | 37216 | 2-3 | -/+ | | - |
| 25 | 33002 | 0 | - | - | |
| 26 | 32756 | $1^{>50\%}$ | | | - |
| 27 | 35667 | | -/+ | | - (In situ) |
| 28 | 36420 | | | | + |
| 29 | 36393 | $1^{1\text{-}25\%}$ | | | - |
| 30 | 36416 | $2^{<1\%}$ | - | +/- | |

| Sample | Specimen ID | GFR Score | ER Status | PR Status | HER2 Status |
|---|---|---|---|---|---|
| 31 | 26250 | $2^{1\text{-}25\%}$ | | | - |
| 32 | 26251 | 0 | - | - | - |
| 33 | 37222 | 2-3 | | | - |
| 34 | 37223 | $1\text{-}2^{1\text{-}25\%}$ | | | |
| 35 | 37217 | $2\text{-}3^{1\text{-}25\%}$ | | | - |
| 36 | 37218 | $2^{<1\%}$ | - | | - |
| 37 | 33357 | $1^{>50\%}$ | - | - | - |
| 38 | 32765 | $1^{>50\%}$ | - | - | - |
| 39 | 24507 | 0 | - | - | |
| 40 | 33687 | $2^{1\text{-}25\%}$ | | - | - |
| 41 | 32997 | 1 | - | | - |
| 42 | 37527 | | | | - |
| 43 | 31089 | $2^{<1\%}$ | | | - |
| 44 | 37155 | 0 | - | +/- | - |
| 45 | 37224 | 2-3 | | | - |
| 46 | 37227 | $2\text{-}3^{1\text{-}25\%}$ | | | - |
| 47 | 37219 | NI | | - | - |
| 48 | 37220 | 3 | - | - | - |
| 49 | 33261 | $1\text{-}2^{1\text{-}25\%}$ | | - | - |
| 50 | 33356 | NI | NI | NI | NI |
| 51 | 36411 | 0 | - | - | - |
| 52 | 36391 | 1 | - | - | - |
| 53 | 36417 | 0 | NI | | - |
| 54 | 32758 | $2\text{-}3^{1\text{-}25\%}$ | | | - |
| 55 | 37153 | 1-2 | - | - | |
| 56 | 37207 | 2-3 | - | | - |
| 57 | 37213 | NI | | | NI |
| 58 | 37228 | $1^{1\text{-}25\%}$ | | | - |
| 59 | 37221 | $1\text{-}2^{>50\%}$ | - | - | - |
| 60 | 34354 | $2^{<1\%}$ | - | - | ID |
| 61 | 37792 | NI | - | - | - |

GFRa1 (04-0019) Expression in Breast and Kidney Cell Lines and Tumors

GFRa1 mRNA Expression Analysis in Multiple Tumor Tissues

Knockdown of GFRa1 (04-0019) mRNA Inhibits Proliferation in Lung and Kidney Cancer Cells

* Reproducible 35% (except 25% for Calu-1) or greater decrease in proliferation

Knockdown of GFRa1 (04-0019) mRNA Induces Apoptosis in Kidney Cancer Cells

* Reproducible 50% or greater increase in apoptosis

Knockdown of GFRa1 (04-0019) mRNA Induces Apoptosis and Inhibits Proliferation in Caki-1 Kidney Cancer Cells

Ligand of GFRa1 (04-0019) (GDNF) Increases Proliferation of GFRa1 Positive MCF-7 Breast Cancer cells

GFRa1 Kinase Binding Partner (Ret) Kinase Inhibitors Inhibit Proliferation Induced by GFRa1 (04-0019) Ligand (GDNF) in MCF-7 Cells

FIGURE 11
GDNF Ligand IHC

| 04-0019 Ligand | | | | | | |
|---|---|---|---|---|---|---|
| Colon | Lung, NSC | Ovary | Pancreas | Pancreas, Metastatic | Prostate | Breast |
| 0 | $1^{1-25\%}$ | 0 | $2^{>50\%}$ | $1^{>50\%}$ | 0 | $2^{>50\%}$ |
| $2^{<1\%}$ | $2^{1-25\%}$ | $1^{1-25\%}$ | 2 | $2^{>50\%}$ | 0 | 2 |
| 0 | 2 | 0 | 0 | 1 | 0 | $2^{>50\%}$ |
| $2^{1-25\%}$ | $1^{1-25\%}$ | 0 | $2^{>50\%}$ | 2 | 0 | $1^{1-25\%}$ |
| 0 | 0 | 0 | 2 | | 0 | $2^{<1\%}$ |
| $2^{>50\%}$ | $1^{1-25\%}$ | 0 | $1^{1-25\%}$ | | 0 | 1 |
| 0 | $1^{>50\%}$ | 0 | | | 0 | 0 |
| 0 | 2 | $2^{1-25\%}$ | | | 0 | 0 |
| 0 | $2^{1-25\%}$ | 0 | | | 0 | 2 |
| $2^{1-25\%}$ | 1 | 0 | | | 2 | 0 |

Pathologist grading scale 1 2 3

Summary

Antibody to GFRa1 Ligand (GDNF) was evaluated in immunohistochemistry at a concentration of 5 ug/ml on human multi-cancer slides.

Sixty percent of pancreatic carcinomas, 40% of breast carcinomas, 30% of ovarian carcinomas, and 20% of lung non-small cell carcinomas showed faint staining of the majority of neoplastic cells. Ten percent of colon and prostate carcinomas showed some faint staining. Within the faint positive carcinomas, membrane staining was frequently observed. None of the tumors showed moderate or strong staining with this antibody.

FIGURE 12
Ret Kinase Binding Partner IHC

04-0019 Kinase Binding Partner

| Breast | Colon | Lung, NSC | Ovary | Pancreas | Pancreas, Metastatic | Prostate |
|---|---|---|---|---|---|---|
| 0 | 0 | 0 | 0 | $1^{>50\%}$ | 1 | 0 |
| 0 | 0 | $2^{>50\%}$ | 0 | 0 | 0 | 0 |
| 2 | 2 | $1^{>50\%}$ | 0 | 0 | $1^{1-25\%}$ | 0 |
| $3^{>50\%}$ | 0 | 0 | 0 | $2^{>50\%}$ | | $2^{>50\%}$ $3^{>50\%}$ |
| 1 | 0 | 0 | 0 | $2^{>50\%}$ | | $3^{>50\%}$ |
| $2^{>50\%}$ | 0 | 0 | 0 | $2^{>50\%}$ | | 0 |
| 0 | 0 | 0 | 0 | $2^{>50\%}$ | | 0 |
| 3 | 0 | 0 | 0 | | | $2^{>50\%}$ $3^{>50\%}$ |
| 0 | 0 | 0 | 0 | | | $2^{>50\%}$ |
| 0 | 0 | $2^{1-25\%}$ | 0 | | | $3^{>50\%}$ |

Pathologist grading scale 1 2 3

Summary

Antibody RDS-AF1485, a goat polyclonal antibody to non-phosphorylated GFRa1 Kinase Binding Partner (Ret) was evaluated in immunohistochemistry on human multi-cancer sections at 5 ug/ml.

Fifty percent of prostate carcinomas and 40% of breast carcinomas showed faint to moderate staining in the majority of tumor cells. Forty percent of pancreatic carcinomas showed faint staining, with adjacent islets of Langerhans showing moderate staining. Ten percent of colon carcinomas showed faint staining. Ten percent of non-small cell carcinomas of the lung showed faint staining, and ovarian carcinomas were negative. Staining within the carcinoma cells was mostly cytoplasmic, although occasional membrane-associated staining could be seen in subsets of moderately positive cells.

FIGURE 13
Phosphorylated Ret Kinase Binding Partner IHC

Phosphorylated 04-0019 Kinase Binding Partner

| Breast | Colon | Lung, NSC | Ovary | Pancreas | Pancreas, Metastatic | Prostate |
|---|---|---|---|---|---|---|
| 0 | 0 | 0 | 0 | 1 | 0 | 0 |
| $2^{1-25\%}$ | $1^{>50\%}$ | $1^{>50\%}$ | 0 | $2^{>50\%}$ | 0 | 0 |
| $2^{>50\%}$ | 2 | $2^{>50\%}$ | 1 | 0 | 0 | $1^{>50\%}$ |
| 1 | $2^{1-25\%}$ | 0 | 1 | 0 | 1 | 0 |
| 2 | 1 | 1 | $1^{>50\%}$ | $2^{>50\%}$ | | $2^{>50\%}$ |
| 1* | $2^{1-25\%}$ | 1 | 0 | $2^{>50\%}$ | | 0 |
| 1 | 0 | 1 | 0 | | | 0 |
| 2* | 0 | $1^{>50\%}$ | 2* | | | $2^{>50\%}$ |
| $1^{>50\%}$ | 0 | 0 | 1 | | | $1^{>50\%}$* |
| 0 | 0 | 0 | 1 | | | $2^{>50\%}$ |

Pathologist grading scale 1 2 3

Summary

One commercial antibody (a rabbit polyclonal to a peptide phosphorylated at residue Tyr905) was evaluated in immunohistochemistry on human multi-cancer sections at 1:25 and 1:50 dilution.

At a dilution of 1:25, 90% of breast carcinomas, 50% of pancreatic and 30% of ovarian carcinomas showed mostly faint to occasionally moderate staining. Faint staining was seen in 60% of colon carcinomas, 50% of prostate and 40% of lung non-small cell carcinomas. At this dilution, artifactual nuclear staining was also present.

At a dilution of 1:50, 40% of breast, 30% of pancreatic, and prostate, and 10% of carcinomas of the colon, lung, and ovary showed faint staining. Nuclear staining was less prevalent at this antibody dilution. Scores in the following sections reflect this antibody dilution.

This antibody showed mostly cytoplasmic staining, or cytoplasmic and nuclear staining. At both dilutions, moderate to strong staining was seen in residual pancreatic islets of Langerhans.

FIGURE 14
Expression in Breast Cancer Specimens

| | | | Serial Sections | | | |
|---|---|---|---|---|---|---|
| Breast Cancer Patient ID | 04-0019 | | Ligand | MET | Binding Partner | Binding partner |
| | RDI ab | RDS ab | 1st ab | 1st ab | 1st ab | 1st ab |
| 33263 | 0 | 0 | $2^{>50\%}$ | $2^{>50\%}$ | 0 | 0 |
| 33270 | 2 | $1^{<1\%}$ | 2 | 2 | 0 | $2^{1-25\%}$ |
| 32908 | 0 | $3^{<1\%}$ | $1^{1-25\%}$ | 0 | | 1 |
| 31653 | $3^{1-25\%}$ | $4^{1-25\%}$ | $2^{<1\%}$ | 0 | $3^{>50\%}$ | 2 |
| 32928 | | | 0 | 0 | 0 | 1 |
| 33268 | 0 | $3^{1-25\%}$ | 0 | 0 | $2^{>50\%}$ | 1* |
| 33261 | $2^{<1\%}$ | $3^{1-25\%}$ | | | | |
| 26249 | | | 2 | 2 | 3 | 2* |
| 33691 | 0 | $3^{<1\%}$ | | | 0 | $1^{>50\%}$ |
| 32997 | 0 | | 1 | 1 | 1 | |
| 32758 | | $3^{>50\%}$ | 0 | 0 | 0 | 0 |
| 32756 | | | $2^{>50\%}$ | 1 | 2 | $2^{>50\%}$ |

FIGURE 15
Evaluation of Level and Homogeneity of GFRa1 Expression in Tumor Tissues: 1st Ab Normal Breast

Breast Tumor

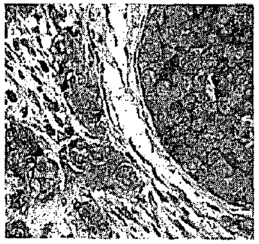

Pathologist grading scale 1 2 3

| | Bladder | Brain, Glioblastoma | Breast | Colon | Esophageal | Kidney | Liver | Lung, NSC | Lung, Squamous | Melanoma, Lymph Node | Non-Hodgkin's Lymphoma, Lymph Node | Ovary | Pancreas | Metastatic pancreatic tissue | Pharynageal | Prostate | Skin, Melanoma | Gastric |
|---|---|---|---|---|---|---|---|---|---|---|---|---|---|---|---|---|---|---|
| 1 | $2^{1-25\%}$ | 0 | 0 | 0 | 0 | 0 | $1^{>50\%}$ | $1^{1-25\%}$ | 0 | 0 | 0 | $1^{>50\%}$ | 0 | 0 | 0 | 0 | 0 | 0 |
| 2 | $2^{1-25\%}$ | $1^{1-25\%}$ | 2 | 0 | 0 | $1^{1-25\%}$ | 0 | $1^{>50\%}$ | 0 | 0 | $2^{<1\%}$ | 0 | 0 | 0 | 0 | 0 | 0 | $1^{>50\%}$ |
| 3 | 0 | 0 | 0 | $1^{<1\%}$ | 0 | 0 | 0 | 0 | $1^{>50\%}$ | 0 | 0 | 0 | 0 | 0 | 0 | 0 | $1^{>50\%}$ | $1^{>50\%}$ |
| 4 | 0 | 0 | $3^{1-25\%}$ | 0 | 0 | 0 | 0 | 0 | 0 | $2^{<1\%}$ | 0 | 0 | 0 | | 0 | 0 | 0 | 0 |
| 5 | 0 | 0 | | 0 | 0 | 0 | $1^{1-25\%}$ | 0 | $2^{1-25\%}$ | 0 | 0 | 0 | 0 | | 0 | 0 | $2^{<1\%}$ | $1^{<1\%}$ |
| 6 | $1^{1-25\%}$ | 0 | 0 | $1^{1-25\%}$ | 0 | 0 | 0 | 0 | 0 | 0 | 0 | 0 | 0 | | $1^{>50\%}$ | 0 | 0 | 0 |
| 7 | 0 | | $2^{<1\%}$ | 0 | 0 | 0 | 0 | 0 | 0 | 0 | | 0 | 0 | | 0 | 0 | 0 | $2^{<1\%}$ |
| 8 | 0 | | | $1^{>50\%}$ | 0 | 0 | $2^{<1\%}$ | 0 | 0 | 0 | | 0 | | | 0 | 0 | 0 | 0 |
| 9 | 0 | | 0 | 0 | 0 | 0 | | 0 | 0 | 0 | | 0 | | | 0 | 0 | $1^{1-25\%}$ | 0 |
| 10 | 0 | | 0 | 0 | $1^{>50\%}$ | $2^{>50\%}$ | | $1^{<1\%}$ | $2^{<1\%}$ | 0 | | $2^{<1\%}$ | | | 0 | 0 | $1^{<1\%}$ | 0 |
| Normal correlate | $1^{>75\%}$ | $3^{1-25\%}$ | $2^{>75\%}$ | $2^{>50\%}$ | 0 | $1^{<1\%}$ | $1^{1-25\%}$ | 1 | 1 | 0 | 0 | 0 | 1 | 1 | 0 | 0 | 0 | $2^{<1\%}$ |
| Overexpression Δ+1 (% tumors) must be at least 2 | 0% | 0% | 20% | 0% | 0% | 10% | 0% | 0% | 0% | 0% | 0% | 0% | 0% | 0% | 0% | 0% | 0% | 0% |
| Overexpression Δ+2 (% tumors) | 0% | 0% | 20% | 0% | 0% | 10% | 0% | 0% | 0% | 0% | 0% | 0% | 0% | 0% | 0% | 0% | 0% | 0% |

Overexpression seen in breast and kidney tumors

FIGURE 16
Evaluation of Level and Homogeneity of GFRa1 Expression in Tumor Tissues: 2nd Ab Normal Breast Breast Tumor

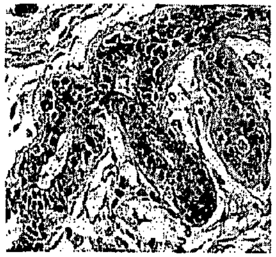

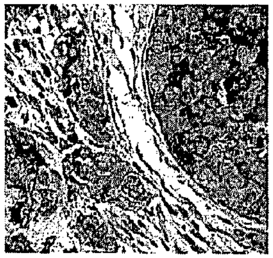

Pathologist grading scale 1 2 3

| | Bladder | Brain, Glioblastoma | Breast | Colon | Esophageal | Kidney | Liver | Lung, NSC | Lung, Squamous | Melanoma, Lymph Node | Non-Hodgkin's Lymphoma, Lymph Node | Ovary | Pancreas | Metastatic pancreatic tissue | Pharynageal | Prostate | Skin, Melanoma | Gastric |
|---|---|---|---|---|---|---|---|---|---|---|---|---|---|---|---|---|---|---|
| 1 | $1^{>50\%}$ | 0 | 0 | $2^{<1\%}$ | 0 | 0 | $1^{>50\%}$ | 0 | 0 | 0 | 0 | 0 | 0 | 0 | 0 | 0 | 0 | 0 |
| 2 | 0 | 0 | $3^{1-25\%}$ | 0 | 0 | 0 | 0 | 0 | 0 | 0 | 0 | 0 | 0 | 0 | 0 | 0 | 0 | 0 |
| 3 | 0 | 0 | $1^{<1\%}$ | 0 | 0 | 0 | 0 | 0 | $2^{1-25\%}$ | 0 | 0 | 0 | 0 | | 0 | 0 | $1^{>50\%}$ | 0 |
| 4 | 0 | 0 | | 0 | 0 | 0 | | 0 | 0 | 0 | 0 | 0 | 0 | | 0 | 0 | 1 | 0 |
| 5 | $1^{>50\%}$ | 0 | $3^{1-25\%}$ | 0 | 0 | 0 | $4^{1-25\%}$ | 0 | 0 | $1^{1-25\%}$ | 0 | 0 | 0 | | 0 | 0 | 0 | 0 |
| 6 | 0– | 0 | $3^{<1\%}$ | 0 | 0 | $1^{>50\%}$ | 0 | 0 | $4^{1-25\%}$ | 0 | 0 | 0 | 0 | | 0 | 0 | $1^{1-25\%}$ | 0 |
| 7 | 0 | | $4^{1-25\%}$ | $3^{<1\%}$ | 0 | 0 | | 0 | 0 | 0 | | 0 | 0 | | $1^{>75\%}$ | $3^{<1\%}$ | 0 | 0 |
| 8 | 0 | | | $3^{1-25\%}$ | 0 | 0 | $3^{1-25\%}$ | 0 | 0 | 0 | | 0 | 0 | | 0 | 0 | 0 | 0 |
| 9 | 0 | | $3^{<1\%}$ | 0 | 0 | 0 | | 0 | 0 | 0 | | 0 | | | 0 | 0 | $1^{>50\%}$ | 0 |
| 10 | $1^{>50\%}$ | | $3^{>50\%}$ | 0 | 0 | $4^{1-25\%}$ | | 0 | $1^{>50\%}$ | 0 | | $3^{1-25\%}$ | | | $2^{<1\%}$ | 0 | $1^{1-25\%}$ | 0 |
| Normal correlate | $1^{>75\%}$ | $3^{<1\%}$ | | $3^{1-25\%}$ | 0 | $3^{<1\%}$ | $1^{1-25\%}$ | $2^{1-25\%}$ | $2^{1-25\%}$ | $1^{>50\%}$ | 0 | $3^{1-25\%}$ | 0 | 0 | 0 | $1^{>50\%}$ | $1^{>50\%}$ | $1^{1-25\%}$ |
| Overexpression $\Delta+1$ (% tumors) must be at least 2 | 0% | 0% | 0% | 0% | 0% | 0% | 25% | 0% | 0% | 0% | 0% | 0% | 0% | 0% | 0% | 0% | 0% | 0% |
| Overexpression $\Delta+2$ (% tumors) | 0% | 0% | 0% | 0% | 0% | 0% | 25% | 0% | 0% | 0% | 0% | 0% | 0% | 0% | 0% | 0% | 0% | 0% |

FIGURE 17
GFRa1 (04-0019) Ligand is Expressed in MCF-7 cells
Cells in culture incubated with GolgiStop for 4 hours; intracellular staining done
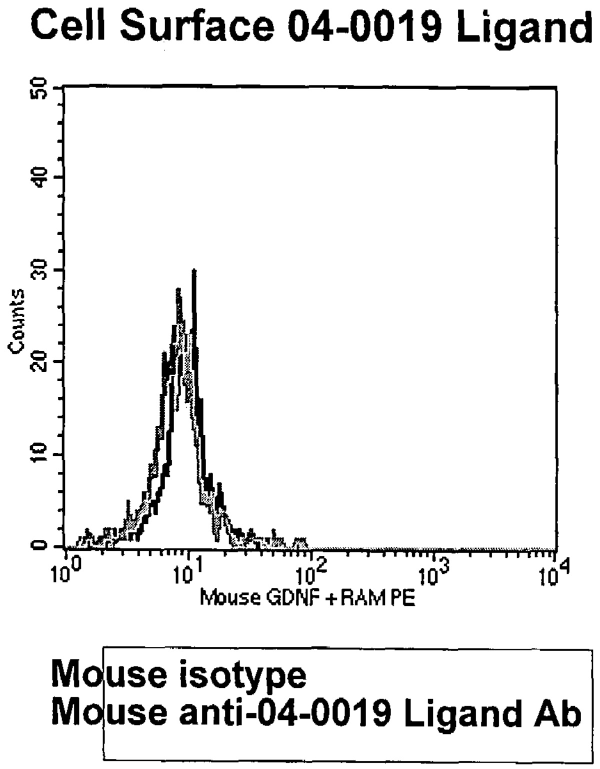
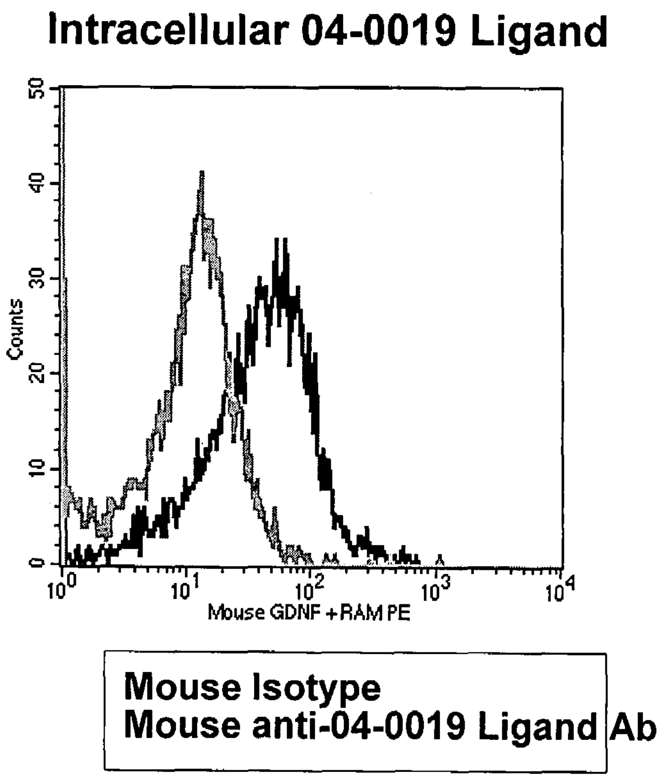

Overexpression of mRNA for GFRa1 in Breast Tumors

Overexpression of mRNA for GFRa1 Kinase Binding Partner in Breast Tumors

Overexpression of mRNA for GFRa1 Ligand in Breast Tumors

P = 0.4763

Statistical Significance (T-test)

This assay approaches the limit of detection.

Both GFRa1 (04-0019) and it's Kinase Binding Partner are Expressed in MCF7 and HCC1937 Breast Cancer Cells

GFRa1 (04-0019) Ligand Increases Proliferation of GFRa1 Positive MCF-7 Breast Cancer cells Ligand of GFRa1 (04-0019) Increases Proliferation of GFRa1 Positive MCF-7 Breast Cancer cells

GFRa1 (04-0019) is Expressed in ACHN and Caki 1 Kidney Cell lines

GFRa1 Peptide Blocks 20ng/ml GDNF (GFRa1 Ligand) Mediated MCF-7 cell Proliferation

GFRa1 (04-0019) Expression in Breast Cell Lines and Tumors

GFRa1 Kinase Binding Partner but not GFRa1 is Expressed in ASPC-1 and BXPC-3 Pancreatic Cancer Cells Heat Denatured GFRa1 (04-0019) Ligand Does not Induce MCF-7 Cell Proliferation

GFRa1 (04-0019) Ligand Binding on MCF-7 Breast Cancer Cells

No treatment+ Isotype mAb

No treatment + Anti-04-0019 LigandmAb

1ug 04-0019 Ligand+ Isotype mAb

1ug 04-0019 Ligand + Anti-04-0019 Ligand mAb

FIGURE 30

GFRa1 Ligand mAb Blocks Binding of GFRa1 Ligand

Binding of GFRa1 Ligand

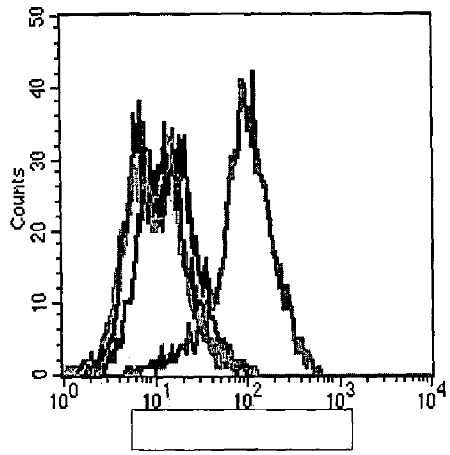

No treatment + Isotype

No treatment + anti-GFRa1 Ligand mAb

1ug GFRa1 Ligand + Isotype mAb

1ug GFRa1 Ligand + anti-GFRa1 Ligand mAb

Blocking of GFRa1 Ligand Binding

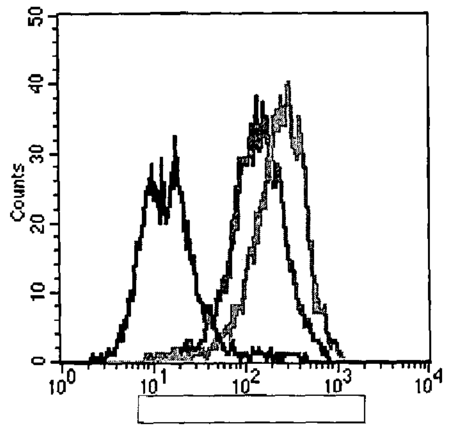

Isotype control

Isotype control preincubation + GFRa1 Ligand + GFRa1 LigandmAb

GFRa1 LigandmAb preincubation + GFRa1 Ligand + GFRa1 Ligand mAb

GFRa1 (04-0019) Ligand-Mediated MCF-7 cell Proliferation Is Blocked by Neutralizing anti-GFRa1 Ligand Ab

Effect of GFRa1 (04-0019) Ligand/GFRa1 Antagonists on MCF-7 Proliferation in Complete Growth Medium (No Exogenous GFRa1 Ligand)

GFRa1 Ligand (GDNF) Increases Proliferation of MCF-7 Breast Cancer cells in a Statistically Significant Manner (n=3)

FIGURE 34
mRNA sequence of GFRa1

GGCCAGAAGAAATCTGGCCTCGGAACACGCCATTCTCCGCGCCGCTTCCAATAACCACTAACATCCCTAACGAGCATCCGAGCCGAGGG
CTCTGCTCGGAAATCGTCCTGGCCCAACTCGGCCCTTCGAGCTCTCGAAGATTACCGCATCTATTTTTTTTTCTTTTTTTTCTTTTCCTAGC
GCAGATAAAGTGAGCCCGGAAAGGGAAGGAGGGGGCGGGGACACCATTGCCCTGAAAGAATAAATAAGTAAATAAACAAACTGGCTCCT
CGCCGCAGCTGGACGCGGTCGGTTGAGTCCAGGTTGGGTCGGACCTGAACCCCTAAAAGCGGAACCGCCTCCCGCCCTCGCCATCCC
GGAGCTGAGTCGCCGGCGGCGGTGGCTGCTGCCAGACCCGGAGTTTCCTCTTTCACTGGATGGAGCTGAACTTTGGGCGGCCAGAGCA
GCACAGCTGTCCGGGGATCGCTGCACGCTGAGCTCCCTCGGCAAGACCCAGCGGCGGCTCGGGATTTTTTTGGGGGGGCGGGGACCA
GCCCCGCGCCGGCACCATGTTCCTGGCGACCCTGTACTTCGCGCTGCCGCTCTTGGACTTGCTCCTGTCGGCCGAAGTGAGCGGCGGA
GACCGCCTGGATTGCGTGAAAGCCAGTGATCAGTGCCTGAAGGAGCAGAGCTGCAGCACCAAGTACCGCACGCTAAGGCAGTGCGTGG
CGGGCAAGGAGACCAACTTCAGCCTGGCATCCGGCCTGGAGGCCAAGGATGAGTGCCGCAGCGCCATGGAGGCCCTGAAGC*AGAAGT*
*CGCTCTACAACTG*CCGCTGCAAGCGGGGTATGAAGAAGGAGAAGAACTGCCTGCGCATTTACTGGAGCATGTACCAGAGCCTGCAGGG
AAATGATCTGCTGGAGGATTCCCCATATGAACCAGTTAACAGCAGATTGTCAGATATATTCCGGGTGGTCCCATTCATATCAGATGTTTTT
CAGCAAGTGGAGCACATTCCCAAAGGGAACAACTGCCTGGATGCAGCGAAGGCCTGCAACCTCGACGACATTTGCAAGAAGTACAGGTC
GGCGTACATCACCCCGTGCACCACCAGCGTGTCCAACGATGTCTGCAACCGCCGCAAGTGCCACAAGGCCCTCCGGCAGTTCTTTGACA
AGGTCCCGGCCAAGCACAGCTACGGAATGCTCTTCTGCTCCTGCCGGGACATCGCCTGCACAGAGCGGAGGCGACAGACCATCGTGCC
TGTGTGCTCCTATGAAGAGA*GGGAGAAGCCCAACTGTTT*GAATTTGCAGGACTCCTGCAAGACGAATTACATCTGCA*GATCTCGCCTTGC*
*GGATTT*TTTTACCAACTGCCAGCCAGAGTCAAGGTCTGTCAGCAGCTGTCTAAAGGAAAACTACGCTGACTGCCTCCTCGCCTACTCGGG
GCTTATTGGCACAGTCATGACCCCCAACTACATAGACTCCAGTAGCCTCAGTGTGGCCCCATGGTGTGACTGCAGCAACAGTGGGAACG
ACCTAGAAGAGTGCTTGAAATTTTTGAATTTCTTCAAGGACAATACATGTCTTAAAAATGCAATTCAAGCCTTTGGCAATGGCTCCGATGTG
ACCGTGTGGCAGCCAGCCTTCCCAGTACAGACCACCACTGCCACTACCACCACTGCCCTCCGGGTTAAGAACAAGCCCCTGGGGCCAG
CAGGGTCTGAGAATGAAATTCCCACTCATGTTTTGCCACCGTGTGCAAATTTACAGGCACAGAAGCTGAAATCCAATGTGTCGGGCAATA
CACACCTCTGTATTTCCAATGGTAATTATGAAAAAGAAGGTCTCGGTGCTTCCAGCCACATAACCACAAAATCAATGGCTGCTCCTCCAAG
CTGTGGTCTGAGCCCACTGCTGGTCCTGGTGGTAACCGCTCTGTCCACCCTATTATCTTTAACAGAAACATCATAGCTGCATTAAAAAAAT
ACAATATGGACATGTAAAAAGACAAAAACCAAGTTATCTGTTTCCTGTTCTCTTGTATAGCTGAAATTCCAGTTTAGGAGCTCAGTTGAGAA
ACAGTTCCATTCAACTGGAACATTTTTTTTTTTTTCCTTTTAAGAAAGCTTCTTGTGATCCTTTGGGGCTTCTGTGAAAAACCTGATGCAGTG
CTCCATCCAAACTCAGAAGGCTTTGGGATATGCTGTATTTTAAAGGGACAGTTTGTAACTTGGGCTGTAAAGCAAACTGGGGCTGTGTTTT
CGATGATGATGATGATCATGATGATGATCATCATGATCATGATGATGATCATCATGATCATGATGATGATTTTAACAGTTTTACTTCTGGCC
TTTCCTAGCTAGAGAAGGAGTTAATATTTCTAAGGTAACTCCCATATCTCCTTTAATGACATTGATTTCTAATGATATAAATTTCAGCCTACA
TTGATGCCAAGCTTTTTTGCCACAAAGAAGATTCTTACCAAGAGTGGGCTTTGTGGAAACAGCTGGTACTGATGTTCACCTTTATATATGTA
CTAGCATTTTCCACGCTGATGTTTATGTACTGTAAACAGTTCTGCACTCTTGTACAAAAGAAAAAACACCTGTCACATCCAAATATAGTATC
TGTCTTTTCGTCAAAATAGAGAGTGGGGAATGAGTGTGCCGATTCAATACCTCAATCCCTGAACGACACTCTCCTAATCCTAAGCCTTACC
TGAGTGAGAAGCCCTTTACCTAACAAAAGTCCAATATAGCTGAAATGTCGCTCTAATACTCTTTACACATATGAGGTTATATGTAGAAAAAA
ATTTTACTACTAAATGATTTCAACTATTGGCTTTCTATATTTTGAAAGTAATGATATTGTCTCATTTTTTTTACTGATGGTTTAATACAAAATACA
CAGAGCTTCTTTCCCCTCAAAAAAAAAAAAAAAAAA (SEQ ID NO:188)

*Bold italics* indicates siRNA target region with biological activity

Bold underlined indicates siRNA target region with dose-dependent biological activity

FIGURE 35
Claudin-4 is Expressed at Cell Surface in Multiple Tumor Types

| | Overexpression Δ+1 (% tumors) | Overexpression Δ+2 (% tumors) |
|---|---|---|
| Breast | 50% | 50% |
| Ovary | 40% | 40% |
| Lung, NSC | 30% | 20% |

FIGURE 36

ASCT2 is Over-expressed in Multiple Tumor Types

| | Over-expression $\Delta$+1 (% tumors) | Over-expression $\Delta$+2 (% tumors) |
|---|---|---|
| Metastatic Pancreas | 57% | 43% |
| Prostate | 40% | 40% |
| Ovary | 30% | 30% |
| Pancreas | 52% | 22% |

ASCT2 mRNA Expression Analysis in Pancreatic Tumors

Knockdown of ASCT2 (0096) mRNA Inhibits Proliferation in Pancreatic, Colon and Breast Cancer Cells

* Reproducible 35% (except Calu-1 25%) or greater decrease in proliferation

Knockdown of ASCT2 (0096) mRNA Inhibits Proliferation in ASPC-1 Pancreatic Cancer Cells Individual siRNA Duplexes Titration of Duplex 2

Knockdown of ASCT2 (0096) mRNA Inhibits Proliferation in HT29 Colon Cancer Cells

FIGURE 41
ASCT2 mRNA sequence

GTAACCGCTACTCCCGGACACCAGACCACCGCCTTCCGTACACAGGGGCCCGCATCCCACCCTCCCGGACCTAAGAGCCTGGGTCCCCTGTTTCCGGAGGTCCGCTTC
CCGGCCCCCAGATTCTGGCATCCCAGCCCTCAGTGTCCAAGACCCAGGCAGCCCGGGTCCCCGCCTCCCGGATCCAGGCGTCCGGGATCTGCGCCACCAGAACCTAG
CCTCCTGCAGACCTCCGCCATCTGGGGGCACTCAACCTCCTGGAGCCAAGGGCCCCACGTCCCACCCAGAGAAACTCTCGTATTCCCAGCTCCTAGGGCCAAGGAACC
CGGGCGCTCCGAACTCCCAGCTTTCGGACATCTGGCACACGGGGCAGAGCAGAGAAGCTCAGCGCCCAGCCTGGGGAATTTAAACACTCCAGCTTCCAAGAGCCAAG
GAACTTCAGTGCTGTGAACTCACAACTCTAAGGAGCCCTCCAAAGTTCCAGTCTCCAGGTGCTGTTACTCAACTCAGTCCTAGGAACGTCGGGTCCTGGGAAGGAGCCC
AAGCGCTCCCAGCCAGCTTCCAGGCGCTAAGAAACCCCGGTGCTTCCCATCATGGTGGCCGATCCTCCTCGAGACTCCAAGGGGCTCGCAGCGGCGGAGCCCACCGC
CAACGGGGGCCTGGCGCTGGCCTCCATCGAGGACCAAGGCGCGGCAGCAGGCGGCTACTGCGGTTCCCGGGACCAGGTGCGCCGCTGCCTTCGAGCCAACCTGCTT
GTGCTGCTGACAGTGGTGGCCGTGGTGGCCGGCGTGGCGCTGGGACTGGGGGTGTCGGGGGCCGGGGGTGCGCTGGCGTTGGGCCCGGAGCGCTTGAGCGCCTTC
GTCTTCCCGGGCGAGCTGCTGCTGCGTCTGCTGCGGATGATCATCTTGCCGCTGGTGGTGTGCAGCTTGATCGGCGGCGCCGCCAGCCTGGACCCCGGCGCGCTCG
GCCGTCTGGGCGCCTGGGCGCTGCTCTTTTTCCTGGTCACCACGCTGCTGGCGTCGGCGCTCGGAGTGGGCTTGGCGCTGGCTCTGCAGCCGGGCGCCGCCTCCGC
CGCCATCAACGCCTCCGTGGGAGCCGCGGGCAGTGCCGAAAATGCCCCCAGCAAGGAGGTGCTCGATTCGTTCCTGGATCTTGCGAGAAATATCTTCCCTTCCAACCT
GGTGTCAGCAGCCTTTCGCTCATACTCTACCACCTATGAAGAGAGGAATATCACCGGAACCAGGGTGAAGGTGCCCGTGGGGCAGGAGGTGGAGGGGATGAACATCCT
GGGCTTGGTAGTGTTTGCCATCGTCTTTGGTGTGGCGCTGCGGAAGCTGGGGCCTGAAGGGGAGCTGCTTATCCGCTTCTTCAACTCCTTCAATGAGGCCACCATGGTT
CTGGTCTCCTGGATCATGTGGTACGCCCCTGTGGGCATCATGTTCCTGGTGGCTGGCAAGATCGTGGAGATGGAGGATGTGGGTTTACTCTTTGCCCGCCTTGGCAAG
TACATTCTGTGCTGCCTGCTGGGTCACGCCATCCATGGGCTCCTGGTACTGCCCCTCATCTACTTCCTCTTCACCCGCAAAAACCCCTACCGCTTCCTGTGGGGCATCGT
GACGCCGCTGGCCACTGCCTTTGGGACCTCTTCCAGTTCCGCCACGCTGCCGCTGATGATGAAGTGCGTGGAGGAGAATAATGGCGTGGCCAAGCACATCAGCCGTTT
CATCCTGCCCATCGGCGCCACCGTCAACATGGACGGTGCCGCGCTCTTCCAGTGCGTGGCCGCAGTGTTCATTGCACAGCTCAGCCAGCAGTCCTTGGACTTCGTAAA
GATCATCACCATCCTGGTCACGGCCACAGCGTCCAGCGTGGGGGCAGCGGGCATCCCTGCTGGAGGTGTCCTCACTCTGGCCATCATCCTCGAAGCAGTCAACCTCCC
GGTCGACCATATCTCCTTGATCCTGGCTGTGGACTGGCTAGTCGACCGGTCCTGTACCGTCCTCAATGTAGAAGGTGACGCTCTGGGGGCAGGACTCCTCCAAAATTAT
GTGGACCGTACGGAGTCGAGAAGCACAGAGCCTGAGTTGATACAAGTGAAGAGTGAGCTGCCCCTGGATCCGCTGCCAGTCCCCACTGAGGAAGGAAACCCCCTCCTC
AAACACTATCGGGGGCCCGCAGGGGATGCCACGGTCGCCTCTGAGAAGGAATCAGTCATGTAAACCCCGGGAGGGACCTTCCCTGCCCTGCTGGGGGTGCTCTTTGG
ACACTGGATTATGAGGAATGGATAAATGGATGAGCTAGGGCTCTGGGGGTCTGCCTGCACACTCTGGGGAGCCAGGGGCCCCAGCACCCTCCAGGACAGGAGATCTG
GGATGCCTGGCTGCTGGAGTACATGTGTTCACAAGGGTTACTCCTCAAAACCCCCAGTTCTCACTCATGTCCCCAACTCAAGGCTAGAAAACAGCAAGATGGAGAAATAA
TGTTCTGCTGCGTCCCCACCGTGACCTGCCTGGCCTCCCCTGTCTCAGGGAGCAGGTCACAGGTCACCATGGGGAATTCTAGCCCCCACTGGGGGGATGTTACAACAC
CATGCTGGTTATTTTGGCGGCTGTAGTTGTGGGGGGATGTGTGTGTGCACGTGTGTGTGTGTGTGTGTGTGTGTGTGTGTGTGTGTTCTGTGACCTCCTGTCCCCATGG
TACGTCCCACCCTGTCCCCAGATCCCCTATTCCCTCCACAATAACAGAAACACTCCCAGGGACTCTGGGGAGAGGCTGAGGACAAATACCTGCTGTCACTCCAGAGGAC
ATTTTTTTTAGCAATAAAATTGAGTGTCAACTATTTAAAAAAAAAAAAAAAAA (SEQ ID NO:189)

Underline indicates siRNA target region with biological activity
Bold underlined indicates siRNA target region with dose-dependent biological activity

FIGURE 42

CD166 is Overexpressed in Multiple Tumor Types

| | Overexpression $\Delta$+1 (% tumors) | Overexpression $\Delta$+2 (% tumors) |
|---|---|---|
| Breast | 60% | 40% |
| Bladder | 30% | 30% |
| Colon | 20% | 20% |

CD166 Overexpression in Tissues by Q-FACS

CD166 Overexpression in Cell Lines by Q-FACS

CD166 mRNA Expression

Breast Normal/Tumor Panel

CD166 mRNA Expression

Colon Normal/Tumor Panel

CD166 mRNA Expression

Matched Colon Normal/Tumor Panel

RNAi Knockdown of CD166 (01-0063) mRNA
Inhibits Proliferation in Multiple Cancer Cells

* Reproducible 35% or greater decrease in proliferation

RNAi Knockdown of CD166 (01-0063) mRNA Induces Apoptosis in Colon and Gastric Cancer Cells

* Reproducible 50% or greater increase in apoptosis

RNAi Knockdown of CD166 (01-0063) mRNA Inhibits Proliferation and Induces Apoptosis in HT29 Colon Cancer Cells

FIGURE 51
RNAi Knockdown of CD166 (01-0063) mRNA Inhibits Proliferation in ASPC-1 Pancreatic Cancer Cells
Individual siRNA Duplexes
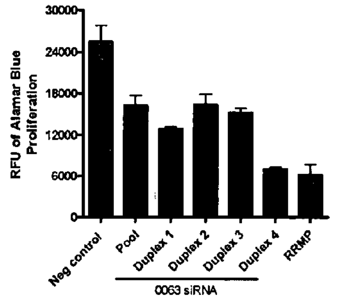
Titration of Duplex 2
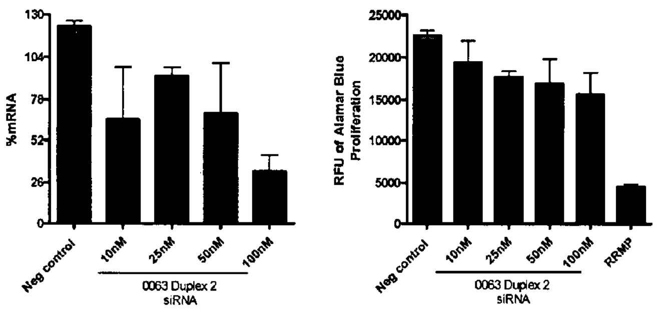

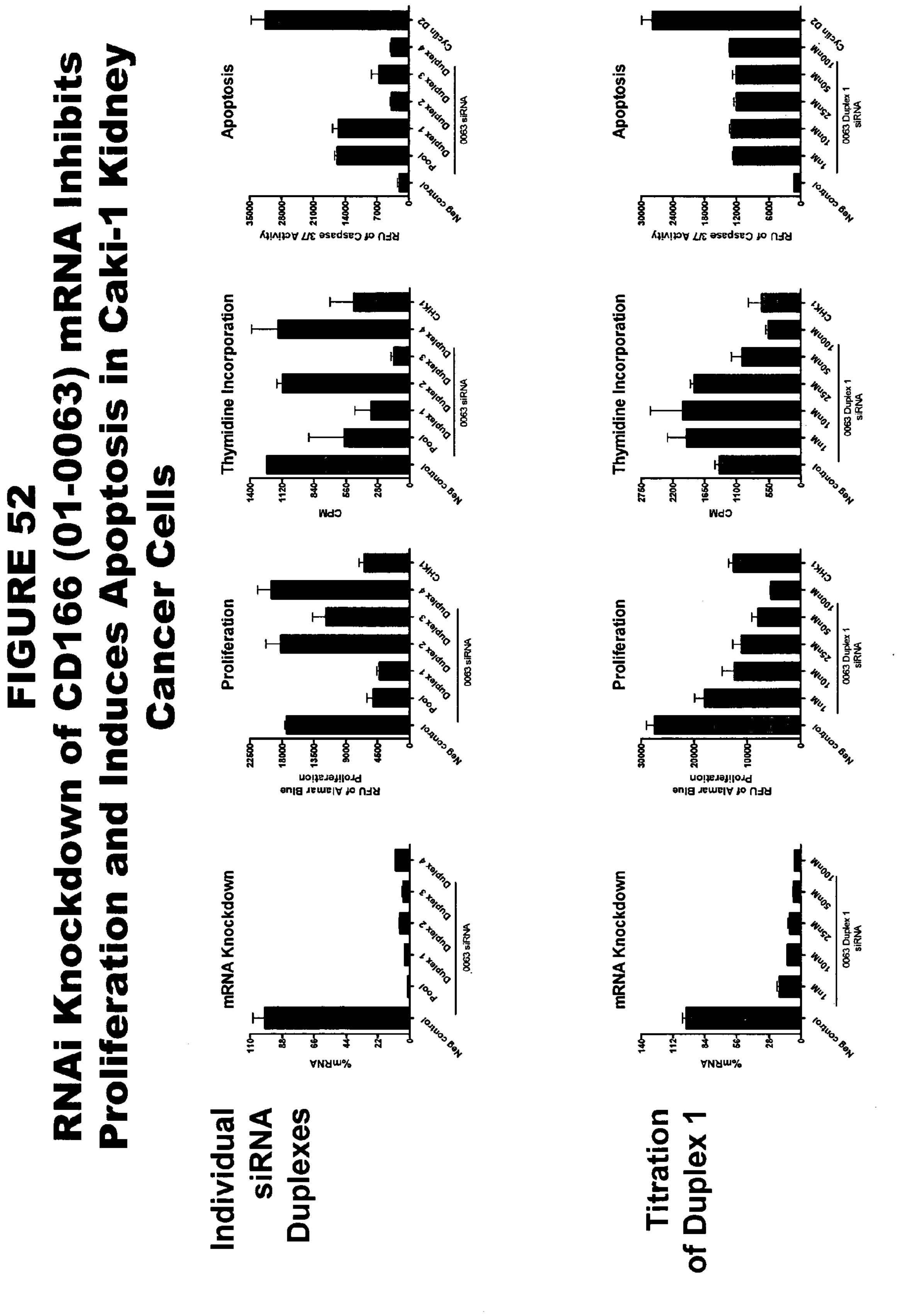
FIGURE 52
RNAi Knockdown of CD166 (01-0063) mRNA Inhibits Proliferation and Induces Apoptosis in Caki-1 Kidney Cancer Cells
Individual siRNA Duplexes
Titration of Duplex 1
mRNA Knockdown
Proliferation
Thymidine Incorporation
Apoptosis
%mRNA
RFU of Alamar Blue Proliferation
CPM
RFU of Caspase 3/7 Activity
Neg control
Pool
Duplex 1
Duplex 2
Duplex 3
Duplex 4
CHK1
Cyclin D2
1nM
10nM
25nM
50nM
100nM
0063 siRNA
0063 Duplex 1 siRNA RNAi Knockdown of CD166 (01-0063) mRNA Inhibits Proliferation in AGS Gastric Cancer Cells
Individual siRNA Duplexes
Titration of Duplex 2
mRNA Knockdown
Proliferation
Thymidine Incorporation
%mRNA
RFU of Alamar Blue Proliferation
CPM
Neg control
Pool
Duplex 1
Duplex 2
Duplex 3
Duplex 4
CHK1
0063 siRNA
1nM
10nM
25nM
50nM
100nM
0063 Duplex 2 siRNA

CD166 (01-0063) siRNA in Combination with Gemzar Increases Apoptosis of BXPC-3 Pancreatic Cancer Cells

IC50

- ▴ Neg Control siRNA+Gemzar: 19nM
- ▪ 01-0063 siRNA + Gemzar: 8nM

Saporin-Conjugated 2nd Ab + CD166 mAb Induces Cell Death in CD166 Positive HCC1954 Breast Cells

Saporin-Conjugated 2nd Ab + CD166 mAb Does Not Induce Cell Death in CD166 Negative HCC1937 Breast Cells

Saporin-Conjugated 2nd Ab+CD166 mAb Induces Cell Death in CD166 Positive HCC1954 Breast Cells

0.21 ug/ml of 2*conjugate is ~ 1uM

~ equimolar [] of each 1* or 2* or Sap was used for each set

Saporin-Conjugated 2nd Ab+CD166 mAb Does Not Induce Cell Death in CD166 Negative HCC1937 Breast Cells

Saporin-Conjugated 2nd Ab+CD166 mAb Induces Cell Death in CD166 Positive HCC1954 Breast Cells

Saporin-Conjugated 2nd Ab+CD166 mAb Does Not Induce Cell Death in CD166 Negative HCC1937 Breast Cells

FIGURE 61 mRNA Sequence of CD166 (ALCAM)

GAAAGAGGCAGCTTACACACGCCTTCCAGTCCCTCTACTCAGAGCAGCCCGGAGACCGCTGCCGCCGCTGCCGCTGCTACCACCGCTGCCACCTGAGGAGACCCGCCGCCCCCCCG
TCGCCGCCTCCTGCGAGTCCTTCTTAGCACCTGGCGTTTCATGCACATTGCCACTGCCATTATTATTATCATTCCAATACAAGGAAAATAAAAGAAGATACCAGCGAAAAGAACCGCTTAC
ACCTTTCCGAATTACTCAAGTGTCTCCTGGAAACAGAGGGTCGTTGTCCCCGGAGGAGCAGCCGAAGGGCCCGTGGGCTGGTGTTGACCGGGAGGGAGGAGGAGTTGGGGGCATTG
CGTGGTGGAAAGTTGCGTGCGGCAGAGAACCGAAGGTGCAGCGCCACAGCCCAGGGGACGGTGTGTCTGGGAGAAGACGCTGCCCCTGCGTCGGGACCCGCCAGCGCGCGGGCAC
CGCGGGGCCCGGGACGACGCCCCCTCCTGCGGCGTGGACTCCGTCAGTGGCCCACCAAGAAGGAGGAGGAATATGGAATCCAAGGGGGCCAGTTCCTGCCGTCTGCTCTTCTGCCT
CTTGATCTCCGCCACCGTCTTCAGGCCAGGCCTTGGATGGTATACTGTAAATTCAGCATATGGAGATACCATTATCATACCTTGCCGACTTGACGTACCTCAGAATCTCATGTTTGGCAAA
TGGAAATATGAAAAGCCCGATGGCTCCCCAGTATTTATTGCCTTCAGATCCTCTACAAAGAAAAGTGTGCAGTACGACGATGTACCAGAATACAAAGACAGATTGAACCTCTCAGAAAAC
TACACTTTGTCTATCAGTAATGCAAGGATCAGTGATGAAAAGAGATTTGTGTGCATGCTAGTAACTGAGGACAACGTGTTTGAGGCACCTACAATAGTCAAGGTGTTCAAGCAACCATCT
AAACCTGAAATTGTAAGCAAAGCACTGTTTCTCGAAACAGAGCAGCTAAAAAAGTTGGGTGACTGCATTTCAGAAGACAGTTATCCAGATGGCAATATCACATGGTACAGGAATGGAAAA
GTGCTACATCCCCTTGAAGGAGCGGTGGTCATAATTTTTAAAAAGGAAATGGACCCAGTGACTCAGCTCTATACCATGACTTCCACCCTGGAGTACAAGACAACCAAGGCTGACATACAA
ATGCCATTCACCTGCTCGGTGACATATTATGGACCATCTGGCCAGAAAACAATTCATTCTGAACAGGCAGTATTTGATATTTACTATCCTACAGAGCAGGTGACAATACAAGTGCTGCCAC
CAAAAAATGCCATCAAAGAAGGGGATAACATCACTCTTAAATGCTTAGGGAATGGCAACCCTCCCCCAGAGGAATTTTTGTTTTACTTACCAGGACAGCCCGAAGGAATAAGAAGCTCAA
ATACTTACACACTGACGGATGTGAGGCGCAATGCAACAGGAGACTACAAGTGTTCCCTGATAGACAAAAAAAGCATGATTGCTTCAACAGCCATCACAGTTCACTATTTGGATTTGTCCT
TAAACCCAAGTGGAGAAGTGACTAGACAGATTGGTGATGCCCTACCCGTGTCATGCACAATATCTGCTAGCAGGAATGCAACTGTGGTATGGATGAAAGATAACATCAGGCTTCGATCT
AGCCCGTCATTTTCTAGTCTTCATTATCAGGATGCTGGAAACTATGTCTGCGAAACTGCTCTGCAGGAGGTTGAAGGACTAAAGAAAAGAGAGTCATTGACTCTCATTGTAGAAGGCAAA
CCTCAAATAAAAATGACAAAGAAAACTGATCCCAGTGGACTATCTAAAACAATAATCTGCCATGTGGAAGGTTTTCCAAAGCCAGCCATTCAATGGACAATTACTGGCAGTGGAAGCGTC
ATAAACCAAACAGAGGAATCTCCTTATATTAATGGCAGGTATTATAGTAAAATTATCATTTCCCCTGAAGAGAATGTTACATTAACTTGCACAGCAGAAAACCAACTGGAGAGAACAGTAA
ACTCCTTGAATGTCTCTGCTATAAGTATTCCAGAACACGATGAGGCAGACGAGATAAGTGATGAAAACAGAGAAAAGGTGAATGACCAGGCAAAACTAATTGTGGGAATCGTTGTTGGTC
TCCTCCTTGCTGCCCTTGTTGCTGGTGTCGTCTACTGGCTGTACATGAAGAAGTCAAAGACTGCATCAAAACATGTAAACAAGGACCTCGGTAATATGGAAGAAAACAAAAAGTTAGAAG
AAAACAATCACAAAACTGAAGCCTAAGAGAGAAACTGTCCTAGTTGTCCAGAGATAAAAATCATATAGACCAATTGAAGCATGAACGTGGATTGTATTTAAGACATAAACAAAGACATTGA
CAGCAATTCATGGTTCAAGTATTAAGCAGTTCATTCTACCAAGCTGTCACAGGTTTTCAGAGAATTATCTCAAGTAAAACAAATGAAATTTAATTACAAACAATAAGAACAAGTTTTGGCAG
CCATGATAATAGGTCATATGTTGTGTTTGGTTCAATTTTTTTTCCGTAAATGTCTGCACTGAGGATTTCTTTTTGGTTTGCCTTTTATGTAAATTTTTTACGTAGCTATTTTTATACACTGTAA
GCTTTGTTCTGGGAGTTGCTGTTAATCTGATGTATAATGTAATGTTTTTATTTCAATTGTTTATATGGATAATCTGAGCAGGTACATTTCTGATTCTGATTGCTATCAGCAATGCCCCAAACT
TTCTCATAAGCACCTAAAACCCAAAGGTGGCAGCTTGTGAAGATTGGGGACACTCATATTGCCCTAATTAAAAACTGTGATTTTTATCACAAGGGAGGGGAGGCCGAGAGTCAGACTGAT
AGACACCATAGGAGCCGACTCTTTGATATGCCACCAGCGAACTCTCAGAAATAAATCACAGATGCATATAGACACACATACATAATGGTACTCCCAAACTGACAATTTTACCTATTCTGAA
AAAGACATAAAACAGAATTTGGTAGCACTTACCTCTACAGACACCTGCTAATAAATTATTTTCTGTCAAAAGAAAAAACACAAGCATGTGTGAGAGACAGTTTGGAAAAATCATGGTCAAC
ATTCCCATTTTCATAGATCACAATGTAAATCACTATAATTACAAATTGGTGTTAAATCCTTTGGGTTATCCACTGCCTTAAAATTATACCTATTTCATGTTTAAAAAGATATCAATCAGAATTG
GAGTTTTTAACAGTGGTCATTATCAAAGCTGTGTTATTTTCCACAGAATATAGAATATATATTTTTTTCGTGTGTGTTTTTGTTAACTACCCTACAGATATTGAATGCACCTTGAGATAATTTA
GTGTTTTTAACTGATACATAATTTATCAAGCAGTACATGAAAGTGTAATAATAAAATGTCTATGTATCTTTAGTTACATTCAAATTTGTAACTTTATAAACATGTTTTATGCTTGAGGAAATTTT
TAAGGTGGTAGTATAAATGGAAACTTTTTGAAGTAGACCAGATATGGGCTACTTGTGACTAGACTTTTAAACTTTGCTCTTTCAAGCAGAAGCCTGGTTTCTGGGAGAACACTGCACAGC
GATTTCTTTCCCAGGATTTACACAACTTTAAAGGGAAGATAAATGAACATCAGATTTCTAGGTATAGAACTATGTTATTGAAAGGAAAAGGAAAACTGGTGTTTGTTTCTTAGACTCATGAA
ATAAAAAATTATGAAGGCAATGAAAAATAAATTGAAAATTAAAGTCAGATGAGAATAGGAATAATACTTTGCCACTTCTGCATTATTTAGAAACATACGTTATTGTACATTTGTAAACCATTT
ACTGTCTGGGCAATAGTGACTCCGTTTAATAAAAGCTTCCGTAGTGCATTGGTATGGATTAAATGCATAAAATATTCTTAGACTCGATGCTGTATAAAATATTATGGGAAAAAAAGAAAATA
TGTTATTTTGCCTCTAAACTTTTATTGAAGTTTTATTTGGCAGGAAAAAAAATTGAATCTTGGTCAACATTTAAACCAAAGTAAAAGGGGAAAAACCAAAGTTATTTGTTTTGCATGGCTAAG
CCATTCTGTTATCTCTGTAAATACTGTGATTTCTTTTTTATTTTCTCTTTAGAATTTTGTTAAAGAAATTCTAAAATTTTTAAACACCTGCTCTCCACAATAAATCACAAACACTAAAATAAAAT
TACTTCCATATAAATATTATTTTCTCTTTTGGTGTGGGAGATCAAAGGTTTAAAGTCTAACTTCTAAGATATATTTGCAGAAAGAAGCAACATGACAATAGAGAGAGTTATGCTACAATTATT
TCTTGGTTTCCACTTGCAATGGTTAATTAAGTCCAAAAACAGCTGTCAGAACCTCGAGAGCAGAACATGAGAAACTCAGAGCTCTGGACCGAAAGCAGAAAGTTTGCCGGGAAAAAAAAA
GACAACATTATTACCATCGATTCAGTGCCTGGATAAAGAGGAAAGCTTACTTGTTTAATGGCAGCCACATGCACGAAGATGCTAAGAAGAAAAAGAATTCCAAATCCTCAACTTTTGAGGT
TTCGGCTCTCCAATTTAACTCTTTGGCAACAGGAAACAGGTTTTGCAAGTTCAAGGTTCACTCCCTATATGTGATTATAGGAATTGTTTGTGGAAATGGATTAACATACCCGTCTATGCCTA
AAAGATAATAAAACTGAAATATGTCTTCAAAAAAAAAAAAAAAAAAAA (SEQ ID NO:190)

Underline indicates siRNA target region with biological activity

Bold underlined indicates siRNA target region with dose-dependent biological activity

FIGURE 62

CD55 is Over-expressed in Multiple Tumor Types

| | Overexpression $\Delta$+1 (% tumors) | Overexpression $\Delta$+2 (% tumors) |
|---|---|---|
| Colon | 30% | 30% |
| Lung, Squamous | 30% | 30% |
| Melanoma, lymph node | 30% | 30% |
| Pancreas | 20% | 20% |
| Bladder | 20% | 20% |
| Lung, Adeno | 10% | 10% |

QFACS Confirms Over-Expression of CD55 (01-0024) on the Surface of Colon Tumors Over-expression of 01-0024 observed on 5/5 colon tumor samples analyzed by QFACS

QFACS Analysis Confirms that CD55 is Differentially Expressed in Colon Tumor Tissues

CD55 (01-0024) Expression Analysis by QFACS

Hematopoietic Cells vs. Colon Tissue

CD55 mRNA Expression Analysis in Tumor Tissues

Knockdown of CD55 (01-0024) mRNA Inhibits Proliferation in Colon and Prostate Cancer Cells

* 35% or greater decrease in proliferation

Knockdown of CD55 (0024) mRNA Inhibits Proliferation in HCT116 Colon Cancer Cells Individual siRNA Duplexes Titration of Duplex 4

CD55 Expression in PBMC and Bone Marrow

CD55 (01-0024) Expression Analysis by QFACS Hematopoietic Cells vs. Colon Cell Lines CD55 (01-0024) Expression Analysis by QFACS Hematopoietic Cells vs. Pancreatic Cell Lines

CD55 Expression in Hematopoietic Cells

| Hematopoietic Cell Populations | PBMC | Bone Marrow |
|---|---|---|
|  | % of population expressing 01-0024 | % of population expressing 01-0024 |
| CD4 T cells | 26.7% | 15.0% |
| CD8 T cells | 43.7% | 67.7% |
| NK cells | 17.9% | 12.6% |
| B cells | 86.4% | 94.7% |
| Monocytes | 80.1% | 97.0% |
| CD34+ cells | 65.6% | 94.2% |

CD55 mRNA Overexpression
Pancreas Cell Line Panel

- Protein identified by MS as overexpressed in HPAF-II
- Overexpression of CD55 correlates at the mRNA level

CD55 (01-0024) mRNA is Overexpressed in Colon Tumor Tissue

CD55 (01-0024) mRNA is Overexpressed in Colon Tumor Tissue 01-0024 MS
Colon Normal/Colon Tumor
Matched samples

CD55 (01-0024) mRNA is Overexpressed in Colon Tumor Tissue

CD55 (01-0024) mRNA Expression in Pancreatic Tumor Tissues

CD55 (01-0024) mRNA Expression in Colon Tumor Tissues

FIGURE 79
CD55 qFACS Data Summary

| Colon Tissue<br>Colon Tissue | Epitope Density |
|---|---|
| Normal - 1 | 2071 |
| Tumor - 1 | 72180 |
| Normal - 2 | 5228 |
| Tumor - 2 | 22339 |
| Normal - 3 | 5658 |
| Tumor - 3 | 15465 |
| Normal - 4 | 1832 |
| Tumor - 4 | 12007 |
| Normal - 5 | 8124 |
| Tumor - 5 | 10881 |

| Colon Cell Lines | Epitope Density |
|---|---|
| Caco-2 | >681322 |
| SW1116 | 233117 |
| SW480 | >681322 |
| LS123 | 666484 |
| SW1417 | 78430 |
| COLO320DM | 114169 |
| COLO205 | 103685 |

FIGURE 80
CD55 qFACS Data Summary

| Breast Cell Lines | Epitope Density |
|---|---|
| HCC1954 | 458972 |
| HCC1937 | 163821 |
| ZR-75-1 | 260357 |
| T-47D | 65278 |

| Panc Cell Lines | Epitope Density |
|---|---|
| Hs766t | >681322 |
| AsPC-1 | >681322 |
| BxPC-3 | 416812 |
| Capan-2 | 505863 |
| HPAC | >681322 |
| HPAF-II | >681322 |
| MiaPaCa-2 | 240236 |
| MPanc-96 | >681322 |
| Panc-1 | 147841 |
| Su.86.86 | >681322 |

FIGURE 81
CD55 is Over-expressed in Multiple Tumor Types

| | Overexpression Δ+1 (% tumors) | Overexpression Δ+2 (% tumors) |
|---|---|---|
| Bladder | 20% | 20% |
| Colon | 10% | 10% |
| Esophagus | 20% | 20% |
| Liver | 38% | 38% |
| Lung, NSC | 10% | 10% |
| Lung, Sq | 20% | 20% |
| Pancreas | 26% | 26% |
| Gastric | 30% | 30% |

FIGURE 82
mRNA sequence of CD55

ATGACCGTCGCGCGGCCGAGCGTGCCCGCGGCGCTGCCCCTCCTCGGGGAGCT
GCCCCGGCTGCTGCTGCTGGTGCTGTTGTGCCTGCCGGCCGTGTGGGGTGACTG
TGGCCTTCCCCCAGATGTACCTAATGCCCAGCCAGCTTTGGAAGGCCGTACAAGT
TTTCCCGAGGATACTGTAATAACGTACAAATGTGAAGAAAGCTTTGTGAAAATTCCT
GGCGAGAAGGACTCAGTGATCTGCCTTAAGGGCAGTCAATGGTCAGATATTGAAG
AGTTCTGCAATCGTAGCTGCGAGGTGCCAACAAGGCTAAATTCTGCATCCCTCAAA
CAGCCTTATATCACTCAGAATTATTTTCCAGTCGGTACTGTTGTGGAATATGAGTG
CCGTCCAGGTTACAGAAGAGAACCTTCTCTATCACCAAAAC*TAACTTGCCTTCAGA*
*AT*TTAAAATGGTCCACAGCAGTCGAATTTTGTAAAAAGAAATCATGCCCTAATCCG
GGAGAAATACGAAATGGTCAGATTGATGTACCAGGTGGCATATTATTTGGTGCAAC
CATCTCCTTCTCATG*TAACACAGGGTACAAATTA*TTTGGCTCGACTTCTAGTTTTT
GTCTTATTTCAGGCAGCTCTGTCCAGTGGAGTGACCCGTTGCCAGAGTGCAGAGA
AATTTATTGTCCAGCACCACCACAAATTGACAATGGAATAATTCAAGGGGAACGTG
ACCATTATGGATATAGACAGTCTGTAACGTATGCATGTAATAAAGGATTCACCATG
ATTGGAGAGCACTCTATTTATTGTACTGTGAATAATGATGAAGGAGAGTGGAGTGG
CCCACCACCTGAATGCAGAGGAAAATCTCTAACTTCCAAGGTCCCACCAACAGTTC
AGAAACCTACCACAGTAAATGTTCCAACTACAGAAGTCTCACCAACTTCTCAGAAA
ACCACCACAAAAACCACCACACCAAATGCTCAAGCAACACGGAGTACACCTGTTTC
CAGGACAACCAAGCATTTTCATGAAACAACCCCAAATAAAGGAAGTGGAACCACTT
CAGGTACTACCCGTCTTCTATCTGGGCACACGTGTTTCACGTTGACAGGTTTGCTT
GGGACGCTAGTAACCATGGGCTTGCTGACTTAG (SEQ ID NO:191)

*Bold italics* indicates siRNA target region with biological activity
Bold underlined indicates siRNA target region with dose-dependent biological activity

FIGURE 83
TG2 is Over-Expressed in Multiple Tumor Types

| | Overexpression Δ+1 (% tumors) | Overexpression Δ+2 (% tumors) |
|---|---|---|
| Pancreas, Metastatic | 100 | 100 |
| Liver | 50 | 50 |
| Pancreas | 44 | 44 |
| Lung, NSC | 20 | 20 |
| Pharyngeal | 20 | 20 |
| Ovary | 20 | 20 |
| Prostate | 20 | 10 |
| Gastric | 10 | 10 |
| Esophageal | 10 | 10 |
| Kidney | 20 | - |
| Bladder | 10 | - |

TG2 mRNA Expression Analysis in Multiple Tumor Tissues

Knockdown of TG2 (PA-01-0029) mRNA Inhibits Proliferation in Pancreas, Lung and Colon Cancer Cells

* Reproducible 35% (except 25% for Calu-1) or greater decrease in proliferation

Knockdown of TG2 (01-0029) mRNA Inhibits Proliferation in HT29 Colon Cells

Knockdown of TG2 (01-0029) mRNA Inhibits Proliferation in Calu1 Lung Cells

Individual siRNA Duplexes

Titration of Duplex 1

Knockdown of TG2 (01-0029) mRNA Inhibits Proliferation in BXPC-3 Pancreas Cells Individual siRNA Duplexes Titration of Duplex 4

FIGURE 89
mRNA sequence of TG2

Ctaagttagcgccgctctccgcctcggcagtgccagccgccagtggtcgcacttggagggtctcgccgccagtggaaggagccaccgcccccgcccgaccatgg<u>ccgaggagctggtcttaga</u>gaggt
gtgatctggagctggagaccaatggccgagaccaccacacggccgacctgtgccgggagaagctggtggtgcgacggggccagcccttctggctgaccctgcactttgagggccgcaactacgaggc
cagtgtagacagtctcaccttcagtgtcgtgaccggcccagcccctagccaggaggccgggaccaaggcccgttttccactaagagatgctgtggaggagggtgactggacagccaccgtggtggacc
agcaagactgcaccctctcgctgcagctcaccaccccggccaacgcccccatcggcctgtatcgcctcagcctggaggcctccactggctaccagggatccagctttgtgctgggccacttcattttgctcttc
aacgcctggtgcccagcggatgctgtgtacctggactcggaagaggagcggcaggagtatgtcctcacccagcagggctttatctaccagggctcggccaagttcatcaagaacataccttggaattttgg
gcagtttgaagatgggatcctagacatctgcctgatccttctagatgtcaaccccaagttcctgaagaacgccggccgtgactgctcccgccgcagcagccccgtctacgtgggccgggtggtgagtggcat
ggtcaactgcaacgatgaccagggtgtgctgctgggacgctgggacaacaactacggggacggcgtcagccccatgtcctggatcggcagcgtggacatcctgcggcgctggaagaaccacggctgc
cagcgcgtcaagtatggccagtgctgggtcttcgccgccgtggcctgcacagtgctgaggtgcctgggcatccctacccgcgtcgtgaccaactacaactcggcccatgaccagaaca<u>gcaaccttctcat</u>
<u>cgagta</u>cttccgcaatgagtttggggagatccagggtgacaagagcgagatgatctggaacttccactgctgggtggagtcgtggatgaccaggccggacctgcagccggggtacgagggctggcagg
ccctggacccaacgccccaggagaagagcgaagggacgtactgctgtggcccagttccagttcgtgccatcaaggagggcgacctgagcaccaagtacgatgcgccctttgtctttgcgga<u>ggtcaatg</u>
<u>ccgacgtggta</u>gactggatccagcaggacgatgggtctgtgcacaaatccatcaaccgttccctgatcgttgggctgaagatcagcactaagagcgtgggccgagacgagcgggaggatatcacccac
acctacaaatacccagaggggtcctcagaggagagggaggccttcacaagggcgaaccacctgaacaaactggccgagaaggaggagacagggatggccatgcggatccgtgtgggccagagc
at<u>gaacatgggcagtgacttt</u>gacgtctttgcccacatcaccaacaacaccgctgaggagtacgtctgccgcctcctgctctgtgcccgcaccgtcagctacaatgggatcttggggcccgagtgtggcacc
aagtacctgctcaacctcaacctggagcctttctctgagaagagcgttcctctttgcatcctctatgagaaataccgtgactgccttacggagtccaacctcatcaaggtgcgggccctcctcgtggagccagtt
atcaacagctacctgctggctgagagggacctctacctggagaatccagaaatcaagatccggatccttggggagcccaagcagaaacgcaagctggtggctgaggtgtccctgcagaacccgctccc
tgtggccctggaaggctgcaccttcactgtggagggggccggcctgactgaggagcagaagacggtggagatcccagaccccgtggaggcaggggaggaagttaaggtgagaatggacctgctgcc
gctccacatgggcctccacaagctggtggtgaacttcgagagcgacaagctgaaggctgtgaagggcttccggaatgtcatcattggccccgcctaagggacccctgctcccagcctgctgagagcccc
caccttgatcccaatccttatcccaagctagtgagcaaaatatgccccttcttgggccccagaccccagggcagggtgggcagcctatgggggctctcggaaatggaatgtgcccctggcccatctcagcc
tcctgagcctgtgggtccccactcaccccctttgctgtgaggaatgctctgtgccagaaacagtgggagccctgaccttggctgactggggctggggtgagagaggaaagacctacattccctctcctgccc
agatgccctttggaaagccattgaccacccaccatattgtttgatctacttcatagctccttggagcaggcaaaaaagggacagcatgccccttggctggatcagggaatccagctccctagactgcatccc
gtacctcttcccatgactgcacccagctccaggggcccttgggacagccagagctgggtggggacagtgataggcccaaggtcccctccacatcccagcagcccaagcttaatagccctccccctcaac
ctcaccattgtgaagcacctactatgtgctgggtgcctcccacacttgctggggctcacggggcctccaacccatttaatcaccatgggaaactgttgtgggcgctgcttccaggataaggagactgaggctt
agagagaggaggcagcccccctccacaccagtggcctcgtggttattagcaaggctgggtaatgtgaaggcccaagagcagagtctgggcctctgactctgagtccactgctccatttataaccccagcct
gacctgagactgtcggagaggctgtctggggcctttatcaaaaaaagactcagccaagacaaggaggtagagaggggactgggggactgggagtcagagccctggctgggttcaggtcccacgtctg
gccaggcactgccttctcctctctgggcctttgtttccttgttggtcagaggagtgattgaaccagctcatctccaaggatcctctccactccatgtttgcaatgcttttatatggcccagccttgtaaataaccacaa
ggtccactccctgctccacgaagccttaagccataggcccaggatatttctgagagtgaaaccatgactgtgaccaccttctgtccccagccctgtcctggttccttcctatgcccaggtaccacccttcagacc
ccagttctaggggagaagagccctggacacccctgctctacccatgagcctgcccgctgcaatgcctagacttcccaacagccttagctgccagtgctggtcactaaccaacaaggttggcaccccagct
accccttctttgcagggctaaggcccccaaacatagcccctgccccggaggaagcttggggaacccatgagttgtcagctttgactttatctcctgctctttctacatgactgggcctcccttgggctggaagaa
ttggggattctctattggaggtgagatcacagcctccagggcccccaaatcccagggaaggacttggagagaatcatgctgttgcatttagaactttctgctttgcacaggaaagagtcacacaattaatca
acatgtatattttctctatacatagagctctatttctctacggttttataaaagccttgggttccaaccaggcagtagatgtgcttctgaaccgcaaggagcaaacactgaaataaaatagtttatttttcacactcaa
aaaaaaaaaaaaaaa (SEQ ID NO:192)

<u>Underline</u> indicates siRNA target region with biological activity
<u>Bold underlined</u> indicates siRNA target region with dose-dependent biological activity

FIGURE 90
CD49f is Over-Expressed in Multiple Tumor Types by IHC

| | Overexpression Δ+1 (% tumors) | Overexpression Δ+2 (% tumors) |
|---|---|---|
| Kidney | 100% | 100% |
| Lung, NSC | 80% | 80% |
| Lung, Squamous | 70% | 70% |
| Pancreas, Metastatic | 67% | 67% |
| Melanoma, Lymph node | 50% | 50% |
| Skin, Melanoma | 50% | 50% |
| Brain, Glioblastoma | 50% | 50% |
| Gastric | 40% | 40% |
| Liver | 38% | 38% |
| Pancreas | 29% | 29% |
| Ovary | 20% | 20% |
| Colon | 20% | 20% |

CD49f is Over-expressed in Colon Tumors Relative to PBMC and Bone Marrow

CD49f mRNA Expression Analysis in Tumor Tissues

Knockdown of CD49f (02-0011) mRNA Inhibits Proliferation in Lung, Colon and Gastric Cancer Cells

* Reproducible 35% or greater decrease in proliferation

Knockdown of CD49f (02-0011) mRNA Inhibits Proliferation in HT29 Colon Cancer Cells

Knockdown of CD49f (02-0011) mRNA Inhibits Proliferation in HCT116 Colon Cancer Cells

FIGURE 96
Knockdown of CD49f (02-0011) mRNA Inhibits Proliferation in NCI-N87 Gastric Cancer Cells
Individual siRNA Duplexes
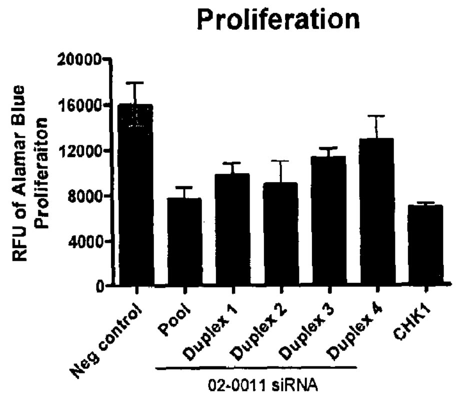
Titration of Duplex 2
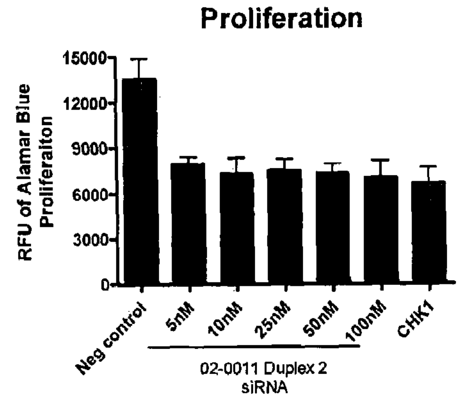

Anti-CD49f (02-0011) Ab blocked H1299 Lung Tumor Cell Line Proliferation

FIGURE 98
mRNA Sequence of CD49f gcgcgaccgtcccgggggtggggccgggcgcagcggcgagaggaggcgaaggtggctgcggtagcagcagcgcggcagcctcggacccagcccggagcgcagggcggccgctgcaggtccccgctcccctccccgtgcgtccgcccatggccgccgccg
ggcagctgtgcttgctctacctgtcggcggggctcctgtcccggctcggcgcagccttcaacttggacactcgggaggacaacgtgatccggaaatatggagaccccgggagcctcttcggcttctcgctggccatgcactggcaactgcagcccgaggacaagcgg
ctgttgctcgtgggggccccgcgcggagaagcgcttccactgcagagagccaacagaacgggagggctgtacagctgcgacatcaccgcccgggggccatgcacgcggatcgagtttgataacgatgctgaccccacgtcagaaagcaaggaagatcagtgg
atgggggtcaccgtccagagccaaggtccagggggcaaggtcgtgacatgtgctcaccgatatgaaaaaaggcagcatgttaatacgaagcaggaatcccgagacatctttgggcggtgttatgtcctgagtcagaatctcaggattgaagacgatatggatgggg
gagattggagcttttgtgatgggcgattgagaggccatgagaaatttggctcttgccagcaaggtgtagcagctacttttactaaagactttcattacattgtatttggagccccgggtacttataactggaaagggattgttcgtgtagagcaaaagaataacactttt
tttgacatgaacatctttgaagatgggccttatgaagttggtggagagactgagcatgatgaaagtctcgttcctgttcctgctaacagttacttaggtttttctttggactcagggaaaggtattgtttctaaagatgagatcacttttgtatctggtgctcccagagccaatcaca
gtggagccgtggttttgctgaagagagacatgaagtctgcacatctcctccctgagcacatattcgatggagaaggtctggcctcttcatttggctatgatgtggcggtggtggacctcaacaaggatgggtggcaagatatagttattggagccccacagtattttgatag
agatggagaagttggaggtgcagtgtatgtctacatgaaccagcaaggcagatggaataatgtgaagccaattcgtcttaatggaaccaaagattctatgtttggcattgcagtaaaaaatattggagatattaatcaagatggctacccagatattgcagttggagctc
cgtatgatgacttgggaaaggtttttatctatcatggatctgcaaatggaataaataccaaaccaacacaggttctcaagggtatatcaccttattttggatattcaattgctggaaacatggaccttgatcgaaattcctaccctgatgttgctgttggttccctctcagattcagt
aactattttcagatcccggcctgtgattaatattcagaaaaccatcacagtaactcctaacagaattgacctccgccagaaaacagcgtgtggggcgcctagtg<u>ggatatgcctccaggttaa</u>atcctgttttgaatatactgctaaccccgctggttataatccttc
aatatcaattgtgggcacacttgaagctgaaaaagaaagaagaaaatctgggctatcctcaagagttcagtttcgaaaccaaggttctgagcccaaatatactcaagaactaactctgaagaggcagaaacagaaagtgtgcatggaggaaaccctgtggctaca
ggataatatcagagataaactgcgtcccattcccataactgcctcagtggagatccaagagccaagctctcgtaggcgagtgaattcacttccagaagttcttccaattctgaattcagatgaacc<u>caagacagctcatattgat</u>gttcacttcttaaaagaggga
tgtggagacgacaatgtatgtaacagcaaccttaaactagaatataaattttgcacccgagaaggaaatcaagacaaattttcttatttaccaattcaaaaaggtgtaccagaactagttctaaaagatcagaaggatattgcttagaaataacagtgacaaacagcc
cttccaacccaaggaatcccacaaaagatggcgatgacgcccatgaggctaaactgattgcaacgtttccagacactttaacctattctgcatatagagaactgagggctttccctgagaaacagttgagttgtgttgccaaccagaatggctcgcaagctgactgtga
gctcggaaatccttttaaaagaaattcaaatgtcactttttatttggttttaagtacaactgaagtcacctttgacaccccatatctggatattaatctgaagttagaaacaacaagcaatcaagataatttggctccaattacagctaaagcaaaagtggttattgaac
tgcttttatcggtctcgggagttgctaaaccttcccaggtgtatttggaggtacagttgttggcgagcaagctatgaaatctgaagatgaagtgggaagtttaatagagtatgaattcagggtaataaacttaggtaaacctcttacaaacctcggcacagcaaccttgaac
attcagtggccaaaagaaattagcaatgggaaatggttgctttatttggtgaaagtagaatccaaaggattggaaaaggtaacttgtgagccacaaaaggagataaactccctgaacctaacggagtctcacaactcaagaaagaaacgggaaattactgaaaaa
cagatagatgataacagaaaattttctttatttgctgaaagaaaataccagactcttaactgtagcgtgaacgtgaactgtgtgaacatcagatgcccgctgcgggggctggacagcaaggcgtctcttattttgcgctcgaggttatggaacagcacatttctagaggaat
attccaaactgaactacttggacattctcatgcgagccttcattgatgtgactgctgctgccgaaaatatcaggctgccaaatgcaggcactcaggttcgagtgactgtgtttccctcaaagactgtagctcagtattcgggagtaccttggtggatcatcctagtggctattct
cgctgggatcttgatgcttgctttattagtgtttatactatggaagtgtggtttcttcaagagaaataagaaagatcattatgatgccacatatcacaaggctgagatccatgctcagccatctgataaagagaggcttacttctgatgcatagtattgatctacttctgtaattgtgt
ggattctttaaacgctctaggtacgatgacagtgttccccgataccatgctgtaaggatccggaaagaagagcgagagatcaaagatgaaaagtatattgataaccttgaaaaaaaacagtggatcacaaagtggaacagaaatgaaagctactcatagcggggg
cctaaaaaaaaaaaagcttcacagtacccaaactgctttttccaactcagaaattcaatttggatttaaaagcctgctcaatccctgaggactgatttcagagtgactacacacagtacgaacctacagttttaactgtggatattgttacgtagcctaaggctcctgttttgca
cagccaaatttaaaactgttggaatggattttctttaactgccgtaatttaactttctgggttgcctttgtttttggcgtggctgacttacatcatgtgttggggaagggcctgcccagttgcactcaggtgacatcctccagatagtgtagctgaggaggcacctacactcacctg
cactaacagagtggccgtcctaacctcgggcctgctgcgcagacgtccatcacgttagctgtcccacatcacaagactatgccattggggtagttgtgtttcaacggaaagtgctgtcttaaactaaatgtgcaatagaaggtgatgttgccatcctaccgtcttttcctgtttc
ctagctgtgtgaatacctgctcacgtcaaatgcatacaagtttcattctccctttcactaaaaacacacaggtgcaacagacttgaatgctagttatacttatttgtatatggtatttatttttcttttctttacaaaccattttgttattgactaacaggccaaagagtctccagtttacc
cttcaggttggtttaatcaatcagaattagaattagagcatgggagggtcatcactatgacctaaattatttactgcaaaaagaaaatctttataaatgtaccagagagagttgttttaataacttatctataaactataacctctccttcatgacagcctccaccccacaaccc
aaaaggtttaagaaatagaattataactgtaaagatgtttatttcaggcattggatatttttactttagaagcctgcataatgtttctggatttacatactgtaacattcaggaattcttggagaagatgggtttattcactgaactctagtgcggtttactcactgctgcaaatactgt
atattcaggacttgaaagaaatggtgaatgcctatggaactagtggatccaaactgatccagtataagactactgaatctgctaccaaaacagttaatcagtgagtcgagtgttctatttttgtttgtttcctcccctatctgtattcccaaaaattactttggggctaatttaaca
agaactttaaattgtgttttaattgtaaaaatggcagggggtggaattattactctatacattcaacagagactgaatagatatgaaagctgatttttttaattaccatgcttcacaatgttaagttatatggggagcaacagcaaacaggtgctaatttgttttggatatagtata
agcagtgtctgtgtttgaaagaatagaacacagtttgtagtgccactgttgtttgggggggcttttttcttttccggaaaatccttaaaccttaagatactaaggacgttgttttggttgtacttggaattcttagtcacaaaatatatttgtttacaaaaatttctgtaaaacagg
ttataacagtgtttaaagtctcagtttcttgcttggggaacttgtgtccctaatgtgttagattgctagattgctaaggagctgatacttgacagtttttagacctgtgttactaaaaaaaagatgaatgtcggaaaagggtgttgggagggtggtcaacaaagaaacaaagat
gttatggtgtttagacttatggttgttaaaaatgtcatctcaagtcaagtcactggtctgtttgcattgatacatttttgtactaactagcattgtaaaattatttcatgattagaaattacctgtggatatttgtataaaagtgtgaaataaatttttataaaagtgttcattgtttcgtaac
acagcattgtatatgtgaagcaaactctaaaattataaatgacaacctgaattatctatttcatcaaaaaaaaaaaaaaaaaaaagaaagggattgttcgtgta (SEQ ID NO:193)

Bold indicates siRNA target region with biological activity

<u>Bold underlined</u> indicates siRNA target region with dose-dependent biological activity

FIGURE 99
CD98 is Over-expressed in Multiple Tumor Types

| | Overexpression $\Delta$+1 (% tumors) | Overexpression $\Delta$+2 (% tumors) |
|---|---|---|
| Lung, NSC | 100% | 100% |
| Lung, SQ | 100% | 100% |
| Melanoma | 90% | 90% |
| Glioblastoma | 83% | 83% |
| Colon | 90% | 80% |
| Breast | 80% | 50% |

Independent IHC Study Confirms Over-expression in Lung Tumor Tissues

CD98 is Over-expressed in Colon Tumors

Over-expression of CD98 was seen in 100 % of colon tumors (n = 7)

CD98 is Over-expression in Colorectal Tumors by QFACS

CD98 is Over-expressed in Colon Tumors Relative to Normal Colon and CD45+ Cells

- Normal Colon
  - 71.8% EpCAM+
  - 21.6% CD45+
- Colon Tumor
  - 91.6% EpCAM+
  - 8.1% CD45+

CD98 Expression in PBMC and Bone Marrow by FACS

CD98 Over-expression in Lung Tumors by QFACS

CD98 mRNA Expression Analysis in Multiple Tumor Tissues

Knockdown of CD98 (0039) mRNA Inhibits Proliferation in Pancreas, Lung and Breast Cancer Cells

* Reproducible 35% (except 25% for Calu-1) or greater decrease in proliferation

Knockdown of CD98 (0039) mRNA Inhibits Proliferation in H1299 Lung Cancer Cells Individual siRNA Duplexes Titration of Duplex 1

Knockdown of Alternative CD98 (0039) Subunit mRNA Inhibits Proliferation in H1299 Lung Cancer Cells Individual siRNA Duplexes Titration of Duplex 1

Knockdown of CD98 (0039) mRNA Inhibits Proliferation in MPANC-96 Pancreatic Cancer Cells

FIGURE 110
mRNA sequence for CD98 light chain (SLC7A5)

cggcgggcggcgcgcacactgctcgctgggccgcggctcccgggtgtcccaggcccggccggtgcgcagagcatggcgggtgcgggcccgaagcggcgcgcgctagcggcgccggcggccgaggagaaggaagaggcgcgg
gagaagatgctggccgccaagagcgcggacggctcggcgccggcaggcgagggcgagggcgtgaccctgcagcggaacatcacgctgctcaacggcgtggccatcatcgtggggaccattatcggctcgggcatcttcgtgacgc
ccacgggcgtgctcaaggaggcaggctcgccggggctggcgctggtggtgtgggccgcgtgcggcgtcttctccatcgtgggcgcgctctgctacgcggagctcggcaccaccatctccaaatcgggcggcgactacgcctacatgctg
gaggtctacggctcgctgcccgccttcctcaagctctggatcgagctgctcatcatccggccttcatcgcagtacatcgtggccctggtcttcgccacctacctgctcaagccgctcttccccacctgcccggtgcccgaggaggcagccaag
ctcgtggcctgcctctgcgtgctgctgctcacggccgtgaactgctacagcgtgaaggccgccacccgggtccaggatgcctttgccgccgccaagctcctggccctggccctgatcatcctgctgggcttcgtccagatcgggaagggtga
tgtgtccaatctagatcccaacttctcatttgaaggcaccaaactggatgtggggaacattgtgctggcattatacagcggcctctttgcctatggaggatggaattacttgaatttcgtcacagaggaaatgatcaacc
cctacagaaacctgcccctggccatcatcatctccctgcccatcgtgacgctggtgtacgtgctgaccaacctggcctacttcaccaccctgtccaccgagcagatgctgtcgtccgaggccgtggccgtggacttcgggaactatc
acctgggcgtcatgtcctggatcatccccgtcttcgtgggcctgtcctgcttcggctccgtcaatgggtccctgttcacatcctccaggctcttcttcgtggggtcccgggaaggccacctgccctccatcctctccatgatccacccacagctcctc
acccccgtgccgtccctcgtgttcacgtgtgtgatgacgctgctctacgccttctccaaggacatcttctccgtcatcaacttcttcagcttcttcaactggctctgcgtggccctggccatcatcggcatgatctggctgcgccacagaaagcctga
gcttgagcggcccatcaaggtgaacctggccctgcctgtgttcttcatcctggcctgcctcttcctgatcgccgtctccttctggaagacacccgtggagtgtggcatcggcttcaccatcatcctcagcgggctgcccgtctacttcttcggggtct
ggtggaaaaacaagcccaagtggctcctccagggcatcttctccacgaccgtcctgtgtcagaagctcatgcaggtggtcccccaggagacatagccaggaggccgagtggctgccggaggagcatgcgcagaggccagttaaagt
agatcacctcctcgaacccactccggttccccgcaacccacagctcagctgcccatcccagtccctcgccgtccctcccaggtcgggcagtggaggctgctgtgaaaactctggtacgaatctcatccctcaactgagggccagggaccc
aggtgtgcctgtgctcctgcccaggagcagcttttggtctccttgggcccttttcccttccctcctttgtttacttatatatatatttttttttaaacttaaattttgggtcaacttgacaccactaagatgatttttttaaggagctgggggaaggcaggagcct
tcctttctcctgccccaagggcccagaccctgggcaaacagagctactgagacttggaacctcattgctaccacagacttgcactgaagccggacagctgcccagacacatgggcttgtgacattcgtgaaaaccaaccctgtgggcttat
gtctctgccttagggtttgcagagtggaaactcagccgtagggtggcactgggagggggtgggggatctgggcaaggtgggtgattcctcccaggaggtgcttgaggccccgatggactcctgaccataatcctagccccgagacaccat
cctgagccagggaacagccccagggttggggggtgccggcatctcccctagctcaccaggcctggcctctgggcagtgtggcctcttggctatttctgtgtccagttttggaggctgagttctggttcatgcagacaaagccctgtccttcagtct
tctagaaacagagacaagaaaggcagacacaccgcggccaggcacccatgtgggcgcccaccctgggctccacacagcagtgtcccctgccccagaggtcgcagctaccctcagcctccaatgcattggcctctgtaccgcccggc
agccccttctggccggtgctgggttcccactcccggcctaggcacctccccgctctccctgtcacgctcatgtcctgtcctggtcctgatgcccgttgtctaggagacagagccaagcactgctcacgtctctgccgcctgcgtttggaggcccct
gggctctcacccagtccccacccgcctgcagagagggaactagggcaccccttgtttctgttgttcccgtgaatttttttcgctatgggaggcagccgaggcctggccaatgcggcccactttcctgagctgtcgctgcctccatggcagcagc
cagggaccccagaacaagaagaccccgcaggatccctcctgagctcggggggctctgccttctcaggccccgggcttcccttctccccagccagaggtggagccaagtggtccagcgtcactccagtgctcagctgtggctggagga
gctggcctgtggcacagccctgagtgtcccaagccgggagccaacgaagccggacacggcttcactgaccagcggctgctcaagccgcaagctctcagcaagtgcccagtggagcctgccgcccccgcctgggcaccgggacccc
ctcaccatccagtgggcccggagaaacctgatgaacagtttggggactcaggaccagatgtccgtctctcttgcttgaggaatgaagacctttattcaccccctgccccgttgcttcccgctgcacatggacagacttcacagcgtctgctcata
ggacctgcatccttcctggggacgaattccactcgtccaagggacagcccacggtctggaggccgaggaccaccagcaggcaggtggactgactgtgttgggcaagacctcttccctctgggcctgttctcttggctgcaaataaggaca
gcagctggtgccccacctgcctggtgcattgctgtgtgaatccaggaggcagtggacatcgtaggcagccacggccccgggtccaggagaagtgctccctggaggcacgcaccactgcttcccactggggccggcggggcccacgca
cgacgtcagcctcttaccttcccgcctcggctaggggtcctcgggatgccgttctgttccaacctcctgctctgggacgtggacatgcctcaaggatacagggagccggcggcctctcgacggcacgcacttgcctgttggctgctgcggctgt
gggcgagcatgggggctgccagcgtctgttgtggaaagtagctgctagtgaaatggctggggccgctggggtccgtcttcacactgcgcaggtctcttctgggcgtctgagctggggtgggagctcctccgcagaaggttggtggggggtc
cagtctgtgatccttggtgctgtgtgccccactccagcctggggaccccacttcagaaggtaggggccgtgtcccgcggtgctgactgaggcctgcttcccccctcccccctcctgctgtgctggaattccacagggaccagggccaccgcagg
ggactgtctcagaagacttgatttttccgtccctttttctccacactccactgacaaacgtccccagcggtttccacttgtgggcttcaggtgttttcaagcacaacccaccacaacaagcaagtgcattttcagtcgttgtgctttttttgttttgtgctaac
gtcttactaatttaaagatgctgtcggcaccatgtttatttatttccagtggtcatgctcagccttgctgctctgcgtggcgcaggtgccatgcctgctccctgtctgtgtcccagccacgcagggccatccactgtgacgtcggccgaccaggctgg
acaccctctgccgagtaatgacgtgtgtggctgggaccttctttattctgtgttaatggctaacctgttacactgggctgggttgggtagggtgttctggctttttttgtggggtttttatttttaaagaaacactcaatcatccta
(SEQ ID NO: 194)

Bold indicates siRNA target region with biological activity
Bold underlined indicates siRNA target region with dose-dependent biological activity

FIGURE 111
CD104 is Over-expressed in Multiple Tumor Types

| | Overexpression (% tumors) | |
|---|---|---|
| | Δ+1 | Δ+2 |
| Pancreas | 40% | 30% |
| Colon | 10% | 10% |

FIGURE 112
CD104 is Over-expressed in Multiple Tumor Types

| | Overexpression (% tumors) | |
|---|---|---|
| | Δ+1 | Δ+2 |
| Breast | 40% | 40% |
| Liver | 25% | |
| Pancreas | 13% | |
| Gastric | 10% | 10% |

CD104 is Over-expressed in Colon Tissues as Measured by QFACS

CD104 (0012) mRNA Expression in Multiple Tumor Types

Knockdown of CD104 (0012) mRNA Inhibits Proliferation in Colon and Breast Cancer Cells

* Reproducible 35% (except Calu-1 25%) or greater decrease in proliferation

Knockdown of CD104 (0012) mRNA Inhibits Proliferation in HCT116 Colon Cancer Cells

FIGURE 117
mRNA sequence of ß4 Integrin (CD104)

gcgctgcccgcctcgtccccacccccccaacccccgcgcccgccctcggacagtccctgctcgcccgcgcgctgcagccccatctcctagcggcagcccaggcgcggagggagcgagtccgccccgaggtaggtccaggacgggcgcacagcagcagccgaggc
tggccgggagagggaggaagaggatggcagggccacgccccagcccatgggccaggctgctcctggcagccttgatcagcgtcagcctctctgggaccttggcaaaccgctgcaagaaggccccagtgaagagctgcacggagtgtgtccgtgtggataaggactg
cgcctactgcacagacgagatgttcagggaccggcgctgcaacacccaggcggagctgctggccgcgggctgccagcgggagagcatcgtggtcatggagagcagcttccaaatcacagaggagacccagattgacaccaccctgcggcgcagccagat
gtccccccaaggcctgcgggtccgtctgcggcccggtgaggagcggcattttgagctggaggtgtttgagccactggagagccccgtggacctgtacatcctcatggacttctccaactccatgtccgatgatctggacaacctcaagaagatggggcagaacctggctcg
ggtcctgagccagctcaccagcgactacactattggatttggcaagtttgtggacaaagtcagcgtcccgcagacggacatgaggcctgagaagctgaaggagccctggcccaacagtgacccccccttctccttcaagaacgtcatcagcctgacagaagatgtgg
atgagttccggaataaactgcagggagagcggatctcaggcaacctggatgctcctgagggcggcttcgatgccatcctgcagacagctgtgtgcacgagggacattggctggcgcccggacagcacccacctgctggtcttctccaccgagtcagccttccactatga
ggctgatggcgccaacgtgctggctggcatcatgagccgcaacgatgaacggtgccacctggacaccacgggcacctacacccagtacaggacacaggactacccgtcggtgcccaccctggtgcgcctgctcgccaagcacaacatcatccccatctttgctgtcacc
aactactcctatagctactacgagaagcttcacacctatttccctgtctcctcactgggggtgctgcaggaggactcgtccaacatcgtggagctgctggaggaggccttcaatcggatccgctccaacctggacatccgggccctagacagcccccgaggccttcg
gacagaggtcacctccaagatgttccagaagacgaggactgggtcctttcacatccggcgggggaagtgggtatataccaggtgcagctgcgggcccttgagcacgtggatgggacgcacgtgtgccagctgccggaggaccagaagggcaacatccatctgaaac
cttccttctccgacggcctcaagatggacgcgggcatcatctgtgatgtgtgcacctgcgagctgcaaaaagaggtgcggtcagctcgctgcagcttcaacggagacttcgtgtgcggacagtgtgtgtgcagcgagggctggagtggccagacctgcaactgctccaccg
gctctctgagtgacattcagccctgcctgcgggagggcgaggacaagccgtgctccggccgtggggagtgccagtgcgggcactgtgtgtgctacggcgaaggccgctacgagggtcagttctgcgagtatgacaacttccagtgtccccgcacttccgggttcctctgca
atgaccgaggacgctgctccatgggccagtgtgtgtgtgagcctggttggacaggcccaagctgtgactgtcccctcagcaatgccacctgcatcgacagcaatgggggcatctgtaatggacgtggccactgtgagtgtggccgctgccactgccaccagcagtcgctct
acacggacaccatctgcgagatcaactactcggcgatccacccgggcctctgcgaggacctacgctcctgcgtgcagtgccaggcgtggggcaccggcgagaagaaggggcgcacgtgtgaggaatgcaacttcaaggtcaagatggtggacgagcttaagagag
ccgaggaggtggtggtgcgctgctccttccgggacgaggatgacgactgcacctacagctacaccatggaaggtgacggcgcccctgggcccaacagcactgtcctggtgcacaagaagaaggactgccctccgggctccttctggtggctcatcccctgctcctcctc
ctcctgccgctcctggccctgctactgctgctatgctggaagtactgtgcctgctgcaaggcctgcctggcacttctcccgtgctgcaaccgaggtcacatggtgggctttaaggaagaccactacatgctgcgggagaacctgatggcctctgaccacttggacacgcccatg
ctgcgcagcgggaacctcaagggccgtgacgtggtccgctggaaggtcaccaacaacatgcagcggcctggctttgccactcatgccgccagcatcaaccccacagagctggtgccctacgggctgtccttgcgcctggcccgcctttgcaccgagaacctgctgaagc
ctgacactcgggagtgcgcccagctgcgccaggaggtggaggagaacctgaacgaggtctacaggcagatctccggtgtacacaagctccagcagaccaagttccggcagcagcccaatgccgggaaaaagcaagaccacaccattgtggacacagtgctgatgg
cgccccgctcggccaagccggccctgctgaagcttacagagaagcaggtggaacagagggccttccacgacctcaaggtggcccccggctactacaccctcactgcagaccaggacgcccggggcatggtggagttccaggagggcgtggagctggtggacgtac
gggtgcccctctttatccggcctgaggatgacgacgagaagcagctgctggtggaggccatcgacgtgcccgcaggcactgccaccctcggccgccgcctggtaaacatcaccatcatcaaggagcaagccagagacgtggtgtcctttgagcagcctgagttctcggtc
agccgcggggaccaggtggcccgcatccctgtcatccggcgtgtcctggacggcgggaagtcccaggtctcctaccgcacacaggatggcaccgcgcagggcaaccgggactacatccccgtggagggtgagctgctgttccagcctggggaggcctggaaaga
gctgcaggtgaagctcctggagctgcaagaagttgactccctcctgcggggccgccaggtccgccgtttccacgtccagctcagcaaccctaagtttggggcccacctgggccagccccactccaccaccatcatcatcagggacccagatgaactggaccggagc
ttcacgagtcagatgttgtcatcacagccacccccctcacggcgacctgggcgccccgcagaaccccaatgctaaggccgctgggtccaggaagatccatttcaactggctgccccccttctggcaagccaatggggtacagggtaaagtactggattcagggtgactccga
atccgaagcccacctgctcgacagcaaggtgccctcagtggagctcaccaacctgtacccgtattgcgactatgagatgaaggtgtgcgcctacggggctcagggcgagggaccctacagctccctggtgtcctgccgcacccaccaggaagtgcccagcgagccagg
gcgtctggccttcaatgtcgtctcctccacggtgacccagctgagctgggctgagccggctgagaccaacggtgagatcacagcctacgaggtctgctatggcctggtcaacgatgacaaccgacctattgggcccatgaagaaagtgctggttgacaaccctaagaacc
ggatgctgcttattgagaaccttcgggagtcccagccctaccgctacacggtgaaggcgcgcaacggggccggctgggggcctgagcgggaggccatcatcaacctggccacccagcccaagaggcccatgtccatccccatcatccctgacatccctatcgtggacg
cccagagcggggaggactacgacagcttccttatgtacagcgatgacgttctacgctctccatcgggcagccagaggcccagcgtctccgatgacactggctgcggctggaagttcgagcccctgctgggggaggagctggacctgcggcgcgtcacgtggcggctgcc
cccggagctcatcccgcgcctgtcggccagcagcgggcgctcctccgacgccgaggcgccccacgggcccccggacgacggcggcgcgggcgggaagggcggcagcctgccccgcagtgcgacacccgggcccccggagagcacctggtgaatggccggat
ggactttgccttcccgggcagcaccaactccctgcacaggatgaccacgaccagtgctgctgcctatggcacccacctgagcccacacgtgccccaccgcgtgctaagcacatcctccaccctcacacgggactacaactcactgacccgctcagaacactcacactcg
accacactgcccagggactactccaccctcacctccgtctcctcccacgactctcgcctgactgctggtgtgcccgacacgcccacccgcctggtgttctctgccctggggcccacatctctcagagtgagctggcaggagccgcggtgcgagcggccgctgcagggctac
agtgtggagtaccagctgctgaacggcggtgagctgcatcggctcaacatccccaaccctgcccagacctcggtggtggtggaagacctcctgcccaaccactcctacgtgttccgcgtgcgggcccagagccaggaaggctggggccgagagcgtgagggtgtcatc
accattgaatcccaggtgcacccgcagagcccactgtgtcccctgccaggctccgccttcactttgagcactcccagtgccccaggcccgctggtgttcactgccctgagcccagactcgctgcagctgagctgggagcggccacggaggcccaatggggatatcgtcgg
ctacctggtgacctgtgagatggcccaaggaggagggccagccaccgcattccgggtggatggagacagccccgagagccggctgaccgtgccgggcctcagcgagaacgtgccctacaagttcaaggtgcaggccaggaccactgagggcttcgggccagagc
gcgagggcatcatcaccatagagtcccaggatggaggacccttcccgcagctgggcagccgtgccgggctcttccagcacccgctgcaaagcgagtacagcagcatcaccaccacccacaccagcgccaccgagcccttcctagtggatggctgaccctgggggc
ccagcacctggaggcaggcggctccctcacccggcatgtgacccaggagtttgtgagccggacactgaccaccagcggaacccttagcacccacatggaccaacagttcttccaaacttgaccgcaccctgccccacccccgccacgtcccactaggcgtcctcccga
ctcctctcccggagcctcctcagctactccatccttgcacccctgggggcccagcccacccgcatgcacagagcaggggctaggtgtctcctgggaggcatgaagggggcaaggtccgtcctctgtgggcccaaacctatttgtaaccaaagagctgggagcagcacaa
ggacccagcctttgttctgcacttaataaatggttttgctactgctaaaaaaa (SEQ ID NO: 195)

Bold indicates siRNA target region with biological activity
Bold underlined indicates siRNA target region with dose-dependent biological activity

FIGURE 118
DPEP1 is Over-Expressed in Colon Carcinoma

| | Overexpression $\Delta$+1 (% tumors) | Overexpression $\Delta$+2 (% tumors) |
|---|---|---|
| Colon | 30% | 20% |
| Liver | 13% | 13% |
| Gastric | 10% | 10% |
| Prostate | 10% | 10% |

FACS Confirms Over-Expression of DPEP1 on the Surface of Colon Tumors

- Over-expression of DPEP1 observed on 4 / 9 colon tumor samples analyzed by FACS DPEP1 mRNA Expression Analysis in Colon and Lung Tumor Tissues

Knockdown of DPEP1 (03-0014) mRNA Inhibits Proliferation in Colon Cancer Cells

* Reproducible 35% or greater decrease in proliferation

Knockdown of DPEP1 (03-0014) mRNA Increases Apoptosis in Colon Cancer Cells

Knockdown of DPEP1 (03-0014) mRNA Inhibits Proliferation and Induces Apoptosis in HCT116 Colon Cancer Cells

Knockdown of DPEP1 (03-0014) mRNA Inhibits Proliferation in HT29 Colon Cancer Cells

Monoclonal Antibody to DPEP1 Inhibits Proliferation in Colon Cancer Cells

DPEP1 Expression in Colon Cell Lines

FIGURE 127
mRNA sequence of DPEP1

CGGGGGGGTACTGTGCGAGCCCTCAAGGAGGTGGCTGTTCTGTAGCTGGAGAGCTCCGTGGGTGGCAGGACTGAACTTGAACACCAGAA
ACAACCCCCAAGCCTTGTGACCTGGGAGGCAGGAGGCGGGTCTGTCTCCCTGGGACTTGGGTGGCTGAGCCGAGGTACTCGGGACCCTG
TCCCGCGCATGGCAGAGTGGCTCCTCACAGCCTGAAGCTCATCCTTCTGCACGGGCCAGCCAGGCCAGCACAGAGGCACCAGGGCAGCA
GTGCACACAGGTCCCCGGGGACCCCACCATGTGGAGCGGATGGTGGCTGTGGCCCCTTGTGGCCGTCTGCACTGCAGACTTCTTTCGGG
ACGAGGCAGAGAGGATCATGAGGGACTCCCCTGTCATTGATGGGCACAATGACCTCCCCTGGCAGCTGCTGGATATGTTCAACAACCGGC
TGCAGGACGAGAGGGCCAACCTGACCACCTTGGCCGGCACACACACCAACATCCCCAAGCTGAGGGCCGGCTTTGTGGGAGGCCAGTTC
TGGTCCGTGTACACGCCCTGCGACACCCAGAACAAAGACGCCGTGC*GGAGGACGCTGGAGCAGAT*GGACGTGGTCCACCGCATGTGCC*G*
*GATGTACCCGGAGACCTT*CCTGTATGTCACCAGCAGTGCAGGCATTCGGCAGGCCTTCCGGGAAGGGAAGGTGGCCAGCCTGATCGGCG
TGGAGGGCGGCCACTCCATTGACAGCAGTTTGGGCGTCCTGCGGGCACTCTATCAGCTGGGCATGCGGTACCTGACCCTCACCCACAGC
TGCAACACGCCCTGGGCTGACAACTGGCTGGTGGACACGGGAGACAGCGAGCCCCAGAGCCAAGGCTTGTCACCCTTTGGGCAGCGTGT
GGTGAAGGAGCTGAACCGTCTGGGGGTCCTCATCGACTTGGCTCACGTGTCTGTGGCCACCATGAAGGCCACCCTGCAGCTGTCCAGAG
CCCCGGTCATCTTCAGCCACTCCTCGGCCTACAGCGTGTGCGCAAGCCGGCGCAACGTGCCTGACGACGTCCTGAGGCTGGTGAAACAG
ACAGACAGCCTGGTGATGGTGAACTTCTACAACAATTACATTTCCTGCACCAACAAGGCCAACCTGTCCCAAGTGGCCGACCATCTGGATC
ACATCAAGGAGGTGGCAGGAGCCAGAGCCGTGGGTTTTGGTGGGGACTTTGATGGTGTTCCAAGGGTCCCTGAGGGGCTGGAGGACGTC
TCCAAGTATCCAGACCTGATCGCTGAGCTGCTCAGGAGGAACTGGACGGAGGCGGAGGTCAAGGGCGCACTGGCTGACAACCTGCTGAG
GGTCTTCGAGGCTGTGGAACAGGCCAGCAACCTCACACAGGCTCCCGAGGAGGAGCCCATCCCGCTGGACCAGCTGGGTGGCTCCTGCA
GGACCCATTACGGCTACTCCTCTGGGGCTTCCAGCCTCCATCGCCACTGGGGGCTCCTGCTGGCCTCCCTCGCTCCCCTGGTCCTCTGTC
TGTCTCTCCTGTGAAACCTGGGAGACCAGAGTCCCCTTTAGGGTTCCCGGAGCTCCGGGAAGACCCGCCCATCCCAGGACTCCAGATGCC
AGGAGCCCTGCTGCCCACATGCAAGGACCAGCATCTCCTGAGAGGACGCCTGGGCTTACCTGGGGGGCAGGATGCCTGGGGACAGTTCA
GGACACACACACAGTAGGCCCGCAATAAAAGCAACACCCCTT (SEQ ID NO:196)

*Italics underlined* indicates siRNA target region with biological activity
Bold underlined indicates siRNA target region with dose-dependent biological activity

FIGURE 128
TF is Overexpressed in Multiple Tumor Types

| | Overexpression $\Delta$+1 (% tumors) | Overexpression $\Delta$+2 (% tumors) |
|---|---|---|
| Pancreatic | 72% | 72% |
| Pancreatic (Metastatic) | 67% | 67% |
| Liver | 40% | 40% |
| Prostate | 20% | 20% |
| Lung, NSC | 20% | |
| Colon | 10% | 10% |

TF Expression in PBMC and Bone Marrow

TF Expression in Hematopoietic Cells and Pancreatic Cell Lines Measured by QFACS

TF (01-0002) mRNA Expression Analysis in Pancreatic and Lung Tumor Tissues

Knockdown of TF (0002) mRNA Inhibits Proliferation in Multiple Cancer Cells

* Reproducible 35% or greater decrease in proliferation

RNAi Knockdown of TF (0002) mRNA Inhibits Proliferation in H1299 Lung Cancer Cells

FIGURE 134
RNAi Knockdown of TF (0002) mRNA Inhibits Proliferation in ASPC-1 Pancreatic Cancer Cells
Individual siRNA Duplexes
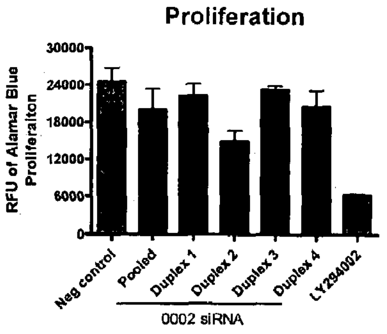
Titration of Duplex 2
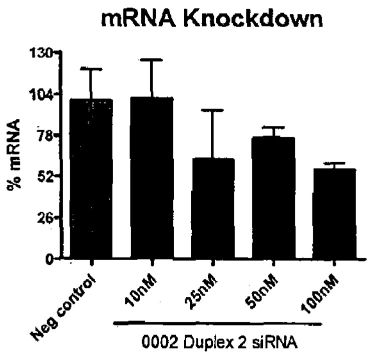
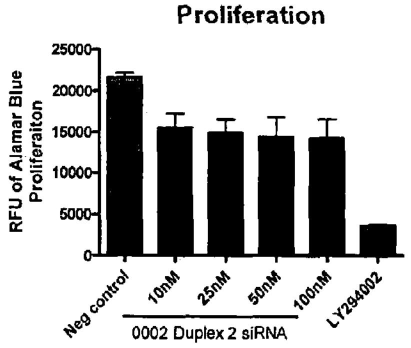

TF-Ligand Activates AKT Signaling Pathway

Elevated Expression of Tissue Factor mRNA in Pancreatic Tumor Tissues

QFACS validation of TF cell-surface tumor expression

FIGURE 138
mRNA sequence of Tissue Factor

Aagactgcgagctccccgcacccccctcgcactccctctggccggcccagggcgccttcagcccaacctccccagccccacgggcgccacggaacccgctcgatctcgcc
gccaactggtagacatggagacccctgcctggccccgggtcccgcgccccgagaccgccgtcgctcggacgctcctgctcggctgggtcttcgcccaggtggccggcgctt
caggcactacaaatactgtggcagcatataatttaacttggaaatcaactaatttcaagacaattttggagtgggaacccaaacccgtcaatcaagtctacactgttcaaataa
gcactaagtcaggagattggaaaagcaaatgcttttacacaacagacacagagtgtgacctcaccgacgagattgtgaaggatgtgaagcagacgtacttggcacgggtc
ttctcctacccggcagggaatgtggagagcaccggttctgctggggagcctctgtatgagaactccccagagttcacaccttacctggagacaaacctcggacagccaaca
attcagagttttgaacaggtgggaacaaaagtgaatgtgaccgtagaagatgaacggactttagtcagaaggaacaacactttcctaagcctccgggatgtttttggcaagg
acttaatttatacactttattattggaaatcttcaagttcaggaaagaaaacagccaaaacaaacactaatgagtttttgattgatgtggataaaggagaaaactactgtttcagtg
ttcaagcagtgattccctcccgaacagttaaccggaagagtacagacagcccggtagagtgtatgggccaggagaaaggggaattcagagaaatattctacatcattgga
gctgtggtatttgtggtcatcatccttgtcatcatcctggctatatctctacacaagtgtagaaaggcaggagtggggcagagctggaaggagaactccccactgaatgtttcata
aaggaagcactgttggagctactgcaaatgctatattgcactgtgaccgagaacttttaagaggatagaatacatggaaacgcaaatgagtatttcggagcatgaagaccct
ggagttcaaaaaactcttgatatgacctgttattaccattagcattctggttttgacatcagcattagtcactttgaaatgtaacgaatggtactacaaccaattccaagttttaatttt
aacaccatggcaccttttgcacataacatgctttagattatatattccgcacttaaggattaaccaggtcgtccaagcaaaaacaaatgggaaaatgtcttaaaaaatcctgggt
ggacttttgaaaagcttttttttttttttttttgagacggagtcttgctctgttgcccaggctggagtgcagtagcacgatctcggctcacttgcaccctccgtctctcgggttcaagcaa
ttgtctgcctcagcctcccgagtagctgggattacaggtgcgcactaccacgccaagctaattttgtatttttagtagagatggggtttcaccatcttggccaggctggtcttgaatt
cctgacctcagtgatccacccaccttggcctcccaaagatgctagtattatgggcgtgaaccaccatgcccagccgaaaagcttttgaggggctgacttcaatccatgtagga
aagtaaaatggaaggaaattgggtgcatttctaggacttttctaacatatgtctataatatagtgtttaggttcttttttttttcaggaatacatttggaaattcaaaacaattgggcaaa
ctttgtattaatgtgttaagtgcaggagacattggtattctgggcagcttcctaatatgctttacaatctgcactttaactgacttaagtggcattaaacatttgagagctaactatatttt
ataagactactatacaaactacagagtttatgatttaaggtacttaaagcttctatggttgacattgtatatataattttttaaaaaggtttttctatatggggattttctatttatgtaggta
atattgttctatttgtatatattgagataatttatttaatatactttaaataaaggtgactgggaattgtt (SEQ ID NO:197)

Bold underlined indicates siRNA target region with dose-dependent biological activity

FIGURE 139

Na-K ATPase β3 is Overexpressed in Multiple Tumor Types

| | Overexpression Δ+1 (% tumors) | Overexpression Δ+2 (% tumors) |
|---|---|---|
| Brain | 100% | 83% |
| Lung, NSC | 80% | 80% |
| Pancreas | 71% | 71% |
| Breast | 70% | 70% |
| Melanoma | 70% | 70% |
| Melanoma, Lymph Node | 70% | 70% |
| Metastatic Pancreatics | 67% | 67% |
| Lung, Squamous | 60% | 60% |
| Colon | 50% | 50% |
| Ovary | 50% | 50% |
| Liver | 38% | 38% |
| Gastric | 30% | 30% |

Na-K ATPase β3 mRNA Overexpression
Lung and Pancreas Tumor Panel

RNAi Knockdown of Na-K ATPase β3 (01-0088) mRNA Inhibits Proliferation in Pancreatic, Lung, Colon, and Kidney Cancer Cells

* Reproducible 35% (except Calu-1 25%) or greater decrease in proliferation

RNAi Knockdown of Na-K ATPase β3 (01-0088) mRNA Induces Apoptosis in Pancreatic, Lung , Breast, Kidney and Gastric Cancer Cells

* Reproducible 50% or greater decrease in proliferation

RNAi Knockdown of Na-K ATPase β3 (01-0088) mRNA Inhibit Proliferation and Induces Apoptosis in MPANC-96 Pancreatic Cancer Cells

RNAi Knockdown of Na-K ATPase β3 (01-0088) mRNA Inhibit Proliferation and Induces Apoptosis in ASPC-1 Pancreatic Cancer Cells

RNAi Knockdown of Na-K ATPase β3 (01-0088) mRNA Inhibit Proliferation and Induces Apoptosis in Caki-1 Kidney Cancer Cells

Anti-Na-K ATPase β3 (01-0088) Antibody Inhibits Proliferation of ASPC-1 and BXPC-3 Pancreatic Cancer Cells

Na-K ATPase β3 (01-0088) siRNA in Combination with Gemzar Increases Apoptosis of BXPC-3 Pancreatic Cancer Cells

FIGURE 148 mRNA sequence of Na/K ATPase beta 3

GGCGCGGCGCGGCGCAGTCGGCTCGAGTACTCCCCGTAACGAGGAGGTGTTCTCGGCCGTCCCACCC
TTCACTGCCGTCTCCGGGCTGCGCCGCCGGAGCCGGGACGCGCCTCCGCAGCCCTCGCCGCCTCCAT
CCCCGCGGCCGCAGCTCCTCTCGCCGTCCGCGCGCACACCATGACGAAGAACGAGAAGAAGTCCCTC
AACCAGAGCCTGGCCGAGTGGAAGCTCTTCATCTACAACCCGACCACCGGAGAATTCCTGGGGCGCAC
CGCCAAGAGCTGGGGTTTGATCTTGCTCTTCTACCTAGTTTTTTATGGGTTCCTGGCTGCACTCTTCTCA
TTCACGATGTGGGTTATGCTTCAGACTCTCAACGATGAGGTTCCAAAATACCGTGACCAGATTCCTAGC
CCAGGACTCATGGTTTTTCCAAAACCAGTGACCGCATTGGAATATACATTCAGTAGGTCTGATCCAACTT
CGTATGCAGGGTACATTGAAGACCTTAAGAAGTTTCTAAAACCATATACTTTAGAAGAACAGAAGAACCT
CACAGTCTGTCCTGATGGAGCACTTTTT<u>GAACAGAAGGGTCCAGTTT</u>ATGTTGCATGTCAGTTTCCTATT
TCATTACTTCAAGCATGCAGTGGTATGAATGATCCTGATTTTGGCTATTCTCAAGGAAACCCTTGTATTCT
TGTGAAAATGAACAGAATAATTGGATTAAAGCCTGAAGGAGTGCCAAGGATAGATTGTGTTTCAAAGAAT
GAAGATATACCAAATGTAGCAGTTTATCCTCATAATGGAATGATAGACTTAAAATATTTCCCATATTATGG
GAAAAAACTGCATGTTGGGTATCTACAGCCATTGGTTGCTGTTCAGGTCAGCTTTGCTCCTAACAACACT
GGGAAAGAAGTAACAGTTGAGTGCAAGATTGATGGATCAGCCAACCTAAAAAGTCAGGATGATCGTGAC
AAGTTTTTGGGACGAGTTATGTTCAAAATCACAGCACGTGCATAGTATGAGTAGGATATCTCCACAGAGT
AAATGTTGTGTTGTCTGTCTTCATTTTGTAACAGCTGGACCTTCCATTCTAGAATTATGAGACCACCTTGG
AGAAAGGTGTGTGGTACATGACATTGGGTTACATCATAACGTGCTTCCAGATCATAGTGTTCAGTGTCCT
CTGAAGTAACTGCCTGTTGCCTCTGCTGCCCTTTGAACCAGTGTACAGTCGCCAGATAGGGACCGGTGA
ACACCTGATTCCAAACATGTAGGATGGGGGTCTTGTCCTCTTTTTATGTGGTTTAATTGCCAAGTGTCTA
AAGCTTAATATGCCGTGCTATGTAAATATTTTATGGATATAACAACTGTCATATTTTGATGTCAACAGAGT
TTTAGGGATAAAATGGTACCCGGCCAACATCAAGTGACTTTATAGCTGCAAGAAATGTGGTATGTGGAG
AAGTTCTGTATGTGAGGAAGGAAAAAAAGAAAATAAAAGTGTGTTTGAAAAATATTATCTTGGGTTCTTTG
TAAAATTTATTTTTTACATGCTGAATTAGCCTCGATCTTTTTGATTAAGAGCACAAACTTTTTTTTGTAAAA
CATGTAAAAAAAAAAACTGGGATTAATTTTTAGTGTTGGAACTGCCTCTTATTTTAGGCTGTAGATAAAAT
AGCATTTTTAGGTTAGCCAGTGTGACTATGCACCTAATTTTTTATGAGATTAAATTCATAAGACTTAATTT
GTACAATAGTTTGTGAAATATCTTGTTACTGCTTTTATTTAGCAGACTGTGGACTGTAATAAAGTA (SEQ ID NO:198)

<u>Bold Underlined</u> indicates siRNA sequence that was titrated

FIGURE 149
VIPR1 is Over-expressed in Multiple Tumor Types

| | Overexpression (% tumors) | |
|---|---|---|
| | Δ+1 | Δ+2 |
| Non-Hodgkin's Lymphoma, Lymph Nodes | 100% | 100% |
| Bladder | 50% | 50% |
| Lung, Squamous | 40% | 40% |
| Ovary | 40% | 40% |
| Liver | 38% | 38% |
| Metastatic Pancreas | 33% | 33% |
| Esophageal | 20% | 20% |
| Pharyngeal | 20% | 20% |

VIPR1 mRNA Expression in Breast and Ovarian Tumors and Normal Tissues

VIPR1 siRNA Screen Data

Anti-Proliferation Activity

VIPR1 (0186) Individual siRNA Duplex Data Anti-Proliferation Activity H1299 Lung Carcinoma Individual siRNA Duplexes Titration of Duplex 4

VIPR1 (0186) Individual siRNA Duplex Data
Anti-Proliferation Activity
Calu-1 Lung Carcinoma

VIPR1 (0186) Individual siRNA Duplex Data Anti-Proliferation Activity HCT116 Colon Carcinoma

Polyclonal Antibody to VIPR1 (04-0186) Inhibits Proliferation in Colon and Breast Cancer Cells Rb IgG Generated to $1^{st}$ Extracellular Loop

FIGURE 156
mRNA sequence of VIPR1

GGCCACAGGCCAGCGCCACTCTGCCAGGCTCCCGGCCATCGCCCGCCTGGTGCGCCGCCCGCCAGCTCTTTGCCCGCGCGGGGCCGCC
CGCCGCGGGCTCAGGGCAGACCATGCGCCCGCCAAGTCCGCTGCCCGCCCGCTGGCTATGCGTGCTGGCAGGCGCCCTCGCCTGGGCC
CTTGGGCCGGCGGGCGGCCAGGCGGCCAGGCTGCAGGAGGAGTGTGACTATGTGCAGATGATCGAGGTGCAGCACAAGCAGTGCCTGGA
GGAGGCCCAGCTGGAGAATGAGACAATAGGCTGCAGCAAGATGTGGGACAACCTCACCTGCTGGCCAGCCACCCCTCGGGGCCAGGTAG
TTGTCTTGGCCTGTCCCCTCATCTTCAAGCTCTTCTCCTCCATTCAAGGCCGCAATGTAAGCCGCAGCTGCACCGACGAAGGCTGGACGCA
CCTGGAGCCTGGCCCGTACCCCATTGCCTGTGGTTTGGATGACAAGGCAGCGAGTTTGGATGAGCAGCAGACCATGTTCTACGGTTCTGTG
AAGACCGGCTACACCATTGGCTACGGCCTGTCCCTCGCCACCCTTCTGGTCGCCACAGCTATCCTGAGCCTGTTCAGGAAGCTCCACTGCA
CGCGGAACTACATCCACATGCACCTCTTCATATCCTTCATCCTGAGGGCTGCCGCTGTCTTCATCAAAGACTTGGCCCTCTTCGACAGCGGG
GAGTCGGACCAGTGCTCCGAGGGCTCGGTGGGCTGTAAGGCAGCCATGGTCTTTTTCCAATATTGTGTCATGGCTAACTTCTTCTGGCTGC
TGGTGGAGGGCCTCTACCTGTACACCCTGCTTGCCGTCTCCTTCTTCTCTGAGCGGAAGTACTTCTGGGGGTACATACTCATCGGCTGGGG
GGTACCCAGCACATTCACCATGGTGTGGACCATCGCCAGGATCCATTTTGAGGATTATGGGTGCTGGGACACCATCAACTCCTCACTGTGG
TGGATCATAAAGGGCCCCATCCTCACCTCCATCTTGGTAAACTTCATCCTGTTTATTTGCATCATCCGAATCCTGCTTCAGAAACTGCGGCC
CCCAGATATCAGGAAGAGTGACAGCAGTCCATACTCAAGGCTAGCCAGGTCCACACTCCTGCTGATCCCCCTGTTTGGAGTACACTACATCA
TGTTCGCCTTCTTTCCGGACAATTTTAAGCCTGAAGTGAAGATGGTCTTTGAGCTCGTCGTGGGGTCTTTCCAGGGTTTTGTGGTGGCTATC
CTCTACTGCTTCCTCAATGGTGAGGTGCAGGCGGAGCTGAGGCGGAAGTGGCGGCGCTGGCACCTGCAGGGCGTCCTGGGCTGGAACCC
CAAATACCGGCACCCGTCGGGAGGCAGCAACGGCGCCACGTGCAGCACGCAGGTTTCCATGCTGACCCGCGTCAGCCCAGGTGCCCGCC
GCTCCTCCAGCTTCCAAGCCGAAGTCTCCCTGGTCTGACCACCAGGATCCCAGGGGCCCAAGGCGGCCCCTCCCGCCCCTTCCCACTCAC
CCCGGCAGACGCCGGGGACAGAGGCCTGCCCGGGCGCGGCCAGCCCCGGCCCTGGGCTCGGAGGCTGCCCCCGGCCCCCTGGTCTCT
GGTCCGGACACTCCTAGAGAACGCAGCCCTAGAGCCTGCCTGGAGCGTTTCTAGCAAGTGAGAGAGATGGGAGCTCCTCTCCTGGAGGAT
TGCAGGTGGAACTCAGTCATTAGACTCCTCCTCCAAAGGCCCCCTACGCCAATCAAGGGCAAAAAGTCTACATACTTTCATCCTGACTCTGC
CCCCTGCTGGCTCTTCTGCCCAATTGGAGGAAAGCAACCGGTGGATCCTCAAACAACACTGGTGTGACCTGAGGGCAGAAAGGTTCTGCCC
GGGGAAGGTCACCAGCACCAACACCACGGTAGTGCCTGAAATTTCACCATTGCTGTCAAGTTCCTTTGGGTTAAGCATTACCACTCAGGCAT
TTGACTGAAGATGCAGCTCACTACCCTATTCTCTCTTTACGCTTAGTTATCAGCTTTTTAAAGTGGGTTATTCTGGAGTTTTTGTTTGGAGAGC
ACACCTATCTTAGTGGTTCCCCACCGAAGTGGACTGGCCCCTGGGTCAGTCTGGTGGGAGGACGGTGCAACCCAAGGACTGAGGGACTCT
GAAGCCTCTGGGAAATGAGAAGGCAGCCACCAGCGAATGCTAGGTCTCGGACTAAGCCTACCTGCTCTCCAAGTCTCAGTGGCTTCATCTG
TCAAGTGGGATCTGTCACACCAGCCATACTTATCTCTCTGTGCTGTGGAAGCAACAGGAATCAAGAGCTGCCCTCCTTGTCCACCCACCTAT
GTGCCAACTGTTGTAACTAGGCTCAGAGATGTGCACCCATGGGCTCTGACAGAAAGCAGATACCTCACCCTGCTACACATACAGGATTTGAA
CTCAGATCTGTCTGATAGGAATGTGAAAGCACGGACTCTTACTGCTAACTTTTGTGTATCGTAACCAGCCAGATCCTCTTGGTTATTTGTTTA
CCACTTGTATTATTAATGCCATTATCCTGAATTCCCCTTGCCACCCCACCCTCCCTGGCGTGTGGCTGAGGAGGCCTCCATCTCATGTATCA
TCTGGATAGGAGCCTGCTGGTCACAGCCTCCTCTGTCTGCCCTTCACCCCAGTGGCCACTCAGCTTCCTACCCACACCTCTGCCAGAAGAT
CCCCTCAGGACTGCAACAGGCTTGTGCAACAATAAATGTTGGCTTGGA (SEQ ID NO:199)

Bold underline indicates siRNA target region with biological activity

FIGURE 157
CD26 is Overexpressed in Multiple Tumor Types

| | Overexpression (% tumors) | |
|---|---|---|
| | Δ+1 | Δ+2 |
| Colon | 50% | 50% |
| Prostate | 50% | 30% |
| Non-Hodgkin's Lymphoma | 50% | 17% |
| Kidney | 50% | 10% |
| Metastatic pancreas | 50% | 0 |
| Liver | 38% | 0 |
| Brain Glioblastoma | 33% | 0 |
| Breast | 30% | 0 |
| Pancreas | 25% | 0 |
| Lung (Squamous) | 20% | 0 |

CD26 mRNA Expression Analysis in Lung and Colon Tumor Tissues

CD26 QFACS Over-expression in Lung and Colon Tumors

- CD26 is over-expressed in 6 / 12 colon tumor specimens evaluated
- CD26 is over-expressed in 3 / 4 lung tumors specimens evaluated CD26 QFACS Over-expression in Lung and Colon Tumors

CD26 QFACS Reveals Low Exprow in Blood and Bone Marrow

Knockdown of CD26 (02-0073) mRNA Inhibits Proliferation in Lung, Gastric, Colon, Breast, Kidney, Gastric and Spheroid Cancer Cells

* Reproducible 35% (except Calu-1 25%) or greater decrease in proliferation

Knockdown of CD26 (02-0073) mRNA Induces Apoptosis in Spheroid Cancer Cells

Knockdown of CD26 (02-0073) mRNA Inhibits Proliferation of Calu-1 Lung Cancer Cells

Knockdown of CD26 (02-0073) Inhibits Proliferation in H1299 Lung Cancer Cells

Knockdown of CD26 (02-0073) Inhibits Proliferation in Caki-1 Kidney Cancer Cells

Knockdown of CD26 (02-0073) Inhibits Proliferation in NCI-N87 Gastric Cancer Cells

FIGURE 168
Knockdown of CD26 (02-0073) Inhibits Proliferation and Induces Apoptosis in H1299-HES Spheroid Cancer Cells
mRNA Knockdown
In progress
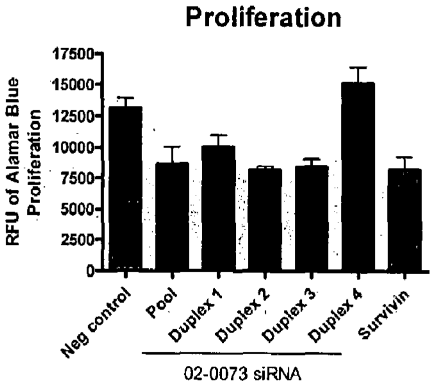
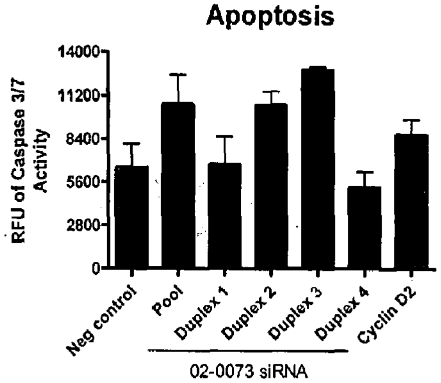
mRNA Knockdown
In progress
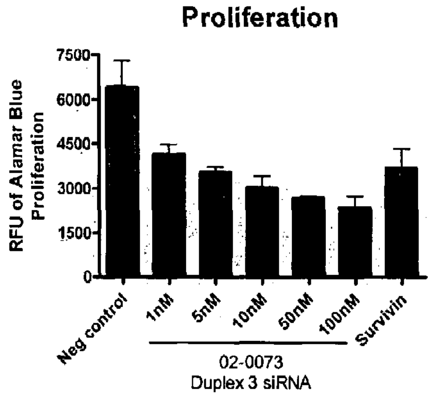
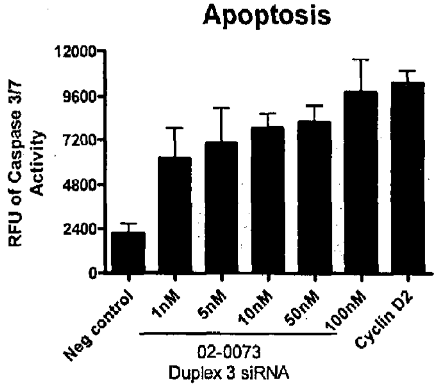

Monoclonal Antibody to CD26 (02-0073) Inhibits Proliferation in Lung and Colon Cancer Cells

FIGURE 170
mRNA sequence of CD26

CTTTCACTGGCAAGAGACGGAGTCCTGGGTTTCAGTTCCAGTTGCCTGCGGTGGGCTGTGTGAGTTTGCCAAAGTCCCCTGCCCTCTCTGGGTCTCGGTTCCCTCGCCTGTCCACGTG
AGGTTGGAGGAGCTGAACGCCGACGTCATTTTTAGCTAAGAGGGAGCAGGGTCCCCGAGTCGCCGGCCCAGGGTCTGCGCATCCGAGGCCGCGCGCCCTTTCCCCTCCCCCACGGC
TCCTCCGGGCCCCGCACTCTGCGCCCCGGCTGCCGCCCAGCGCCCTACACCGCCCTCAGGGGGCCCTCGCGGGCTCCCCCCGGCCGGGATGCCAGTGCCCCGCGCCACGCGCGCCTG
CTCCCGCGCCGCCTGCCCTGCAGCCTGCCCGCGGCGCCTTTATACCCAGCGGGCTCGGCGCTCACTAATGTTTAACTCGGGGCCGAAACTTGCCAGCGGCGAGTGACTCCACCGCCC
GGAGCAGCGGTGCAGGACGCGCGTCTCCGCCGCCCGCGGTGACTTCTGCCTGCGCTCCTTCTCTGAACGCTCACTTCCGAGGAGACGCCGACGATGAAGACACCGTGGAAGGTTCTT
CTGGGACTGCTGGGTGCTGCTGCGCTTGTCACCATCATCACCGTGCCCGTGGTTCTGCTGAACAAAGGCACAGATGATGCTACAGCTGACAGTCGCAAAACTTACACTCTAACTGAT
TACTTAAAAAATACTTATAGACTGAAGTTATACTCCTTAAGATGGATTTCAGATCATGAATATCTCTACAAACAAGAAAATAATATCTTGGTATTCAATGCTGAATATGGAAACAGC
TCAGTTTTCTTGGAGAACAGTACATTTGATGAGTTTGGACATTCTATCAATGATTATTCAATATCTCCTGATGGGCAGTTTATTCTCTTAGAATACAACTACGTGAAGCAATGGAGGC
ATTCCTACACAGCTTCATATGACATTTATGATTTAAATAAAAGGCAGCTGATTACAGAAGAGAGGATTCCAAACAACACACAGTGGGTCACATGGTCACCAGTGGGTCATAAATTGG
CATATGTTTGGAACAATGACATTTATGTTAAAATTGAACCAAATTTACCAAGTTACAGAATCACATGGACGGGGAAAGAAGATATAATATATAATGGAATAACTGACTGGGTTTATG
AAGAGGAAGTCTTCAGTGCCTACTCTGCTCTGTGGTGGTCTCCAAACGGCACTTTTTTAGCATATGCCCAATTTAACGACACAGAAGTCCCACTTATTGAATACTCCTTCTACTCTGA
TGAGTCACTGCAGTACCCAAAGACTGTACGGGTTCCATATCCAAAGGCAGGAGCTGTGAATCCAACTGTAAAGTTCTTTGTTGTAAATACAGACTCTCTCAGCTCAGTCACCAATGC
AACTTCCATACAAATCACTGCTCCTGCTTCTATGTTGATAGGGGATCACTACTTGTGTGATGTGACATGGGCAACACAAGAAAGAATTTCTTTGCAGTGGCTCAGGAGGATTCAGAA
CTATTCGGTCATGGATATTTGTGACTATGATGAATCCAGTGGAAGATGGAACTGCTTAGTGGCACGGCAACACATTGAAATGAGTACTACTGGCTGGGTTGGAAGATTTAGGCCTTC
AGAACCTCATTTTACCCTTGATGGTAATAGCTTCTACAAGATCATCAGCAATGAAGAAGGTTACAGACACATTTGCTATTTCCAAATAGATAAAAAAGACTGCACATTTATTACAAA
AGGCACCTGGGAAGTCATCGGGATAGAAGCTCTAACCAGTGATTATCTATACTACATTAGTAATGAATATAAAGGAATGCCAGGAGGAAGGAATCTTTATAAAATCCAACTTAGT
GACTATACAAAAGTGACATGCCTCAGTTGTGAGCTGAATCCGGAAAGGTGTCAGTACTATTCTGTGTCATTCAGTAAAGAGGCGAAGTATTATCAGCTGAGATGTTCCGGTCCTGGT
CTGCCCCTCTATACTCTACACAGCAGCGTGAATGATAAAGGGCTGAGAGTCCTGGAAGACAATTCAGCTTTGGATAAAATGCTGCAGAATGTCCAGATGCCCTCCAAAAAACTGGA
CTTCATTATTTTGAATGAAACAAAATTTTGGTATCAGATGATCTTGCCTCCTCATTTTGATAAATCCAAGAAATATCCTCTACTATTAGATGTGTATGCAGGCCCATGTAGTCAAAAA
GCAGACACTGTCTTCAGACTGAACTGGGCCACTTACCTTGCAAGCACAGAAAACATTATAGTAGCTAGCTTTGATGGCAGAGGAAGTGGTTACCAAGGAGATAAGATCATGCATGC
AATCAACAGAAGACTGGGAACATTTGAAGTTGAAGATCAAATTGAAGCAGCCAGACAATTTTCAAAA*TGGGATTTGTGGACAACAAA*CGAATTGCAATTTGGGGCTGGTCATATGG
AGGGTACGTAACCTCAATGGTCCTGGGATCGGGAAGTGGCGTGTTCAAGTGTGGAATAGCCGTGGCGCCTGTATCCCGGTGGGAGTACTATGACTCAGTGTACACAGAACGTTACAT
GGGTCTCCCAACTCCAGAAGACAACCTTGACCATTACAGAAATTCAACAGTCATGAGCAGAGCTGAAAATTTTAAACAAGTTGAGTACCTCCTTATTCATGGAACAGCAGATGATAA
CGTTCACTTTCAGCAGTCAGCTCAGATCTCCAAAGCCCTGGTCGATGTTGGAGTGGATTTCCAGGCAATGTGGTATACTGATGAAGACCATGGAATAGCTAGCAGCACAGCACACCA
ACATATATATACCCACATGAGCCACTTCATAAAACAATGTTTCTCTTTACCTTAGCACCTCAAAATACCATGCCATTTAAAGCTTATTAAAACTCATTTTTGTTTTCATTATCTCAAAA
CTGCACTGTCAAGATGATGATGATCTTTAAAATACACACTCAAATCAAGAAACTT*AAGGTTACCTTTGTTCCCAAA*TTTCATACCTATCATCTTAAGTAGGGACTTCTGTCTTCACAAC
AGATTATTACCTTACAGAAGTTTGAATTATCCGGTCGGGTTTTATTGTTTAAAATCATTTCTGCATCAGCTGCTGAAACAACAAATAGGAATTGTTTTTATGGAGGCTTTGCATAGATT
CCCTGAGCAGGATTTTAATCTTTTTCTAACTGGACTGGTTCAAATGTTGTTCTCTTCTTTAAAGGGATGGCAAGATGTGGGCAGTGATGTCACTAGGGCAGGGACAGGATAAGAGGG
ATTAGGGAGAGAAGATAGCAGGGCATGGCTGGGAACCCAAGTCCAAGCATACCAACACGAGCAGGCTACTGTCAGCTCCCCTCGGAGAAGAGCTGTTCACAGCCAGACTGGCACA
GTTTTCTGAGAAAGACTATTCAAACAGTCTCAGGAAATCAAATATGCAAAGCACTGACTTCTAAGTAAAACCACAGCAGTTGAAAAGACTCCAAAGAAATGTAAGGGAAACTGCCA
GCAACGCAGGCCCCCAGGTGCCAGTTATGGCTATAGGTGCTACAAAAACACAGCAAGGGTGATGGGAAAGCATTGTAAATGTGCTTTTAAAAAAAAATACTGATGTTCCTAGTGAA
AGAGGCAGCTTGAAACTGAGATGTGAACACATCAGCTTGCCCTGTTAAAAGATGAAAATATTTGTATCACAAATCTTAACTTGAAGGAGTCCTTGCATCAATTTTTCTTATTTCATTT
CTTTGAGTGTCTTAATTAAAAGAATATTTTAACTTCCTTGGACTCATTTTAAAAAATGGAACATAAAATACAATGTTATGTATTATTATTCCCATTCTACATACTATGGAATTTCTCCC
AGTCATTTAATAAATGTGCCTTCATTTTTTCAGAAA (SEQ ID NO:200)

*Bold italics* indicates siRNA target region with biological activity

Bold underlined indicates siRNA target region with dose-dependent biological activity

FIGURE 171
CXADR is Overexpressed in Multiple Tumor Types

| | Overexpression $\Delta$+1 (% tumors) | Overexpression $\Delta$+2 (% tumors) |
|---|---|---|
| Non-Hodgkin's Lymphoma | 67% | 67% |
| Ovary | 80% | 60% |
| Brain Glioblastoma | 33% | 17% |
| Liver | 38% | 13% |
| Breast | 70% | 0% |

CXADR (03-0036) Expression by FACS in Colon and Lung Cancer Cell Lines

CXADR Expression by FACS in 3D Spheroid Cells Derived from Kidney and Lung Cancer Cell Lines Spheroid
Spheroid→Adherent

CXADR mRNA Expression Analysis in Multiple Tumor Tissues

Knockdown of CXADR (0036) mRNA Inhibits Proliferation in Lung, Colon and Gastric Cancer Cells

* Reproducible 35% (except Calu-1 at 25%) or greater decrease in proliferation

Knockdown of CXADR (03-0036) mRNA Inhibits Proliferation in HCT116 Colon Cells

Knockdown of CXADR (03-0036) mRNA Inhibits Proliferation in HT29 Colon Cells

Individual siRNA Duplexes

Titration of Duplex 3

Monoclonal Antibody to CXADR (03-0036) Inhibits Proliferation in Colon and Lung Cancer Cells

CXADR (03-0036) mRNA is Overexpressed in Colon Tumor Tissues 03-0036 mRNA expression in the Colon Tumor Panel

CXADR is Highly Expressed at mRNA Level in Cancer Cell Lines

CXADR Expression by FACS in 3D Spheroid Cells Derived from Colon and Lung Cancer Cell Lines Colon HT29 Cells Lung H1299 Cells Adherent
Spheroid
Spheroid→Adherent

FIGURE 182
mRNA sequence of CXADR

GGGTGCAGAGGTGCCGCCGCCGCCGCGAGCCAGTCGGGAGCGCGCGAGGCGCGGGGAGCCTGGGACCAGGAGCGAGAGCCGCCTACCTG
CAGCCGCCGCCCACGGCACGGCAGCCACCATGGCGCTCCTGCTGTGCTTCGTGCTCCTGTGCGGAGTAGTGGATTTC<u>GCCAGAAGTTTGAG</u>
<u>TATCA</u>CTACTCCTGAAGAGATGATTGAAAAAGCCAAAGGGGAAACTGCC*TATCTGCCATGCAAATTT*ACGCTTAGTCCCGAAGACCAGGGACC
GCT*GGACATCGAGTGGCTGATA*TCACCAGCTGATAATCAGAAGGTGGATCAAGTGATTATTTTATATTCTGGAGACAAAATTTATGATGACTACT
ATCCAGATCTGAAAGGCCGAGTACATTTTACGAGTAATGATCTCAAATCTGGTGATGCATCAATAAATGTAACGAATTTACAACTGTCAGATATT
GGCACATATCAGTGCAAAGTGAAAAAAGCTCCTGGTGTTGCAAATAAGAAGATTCATCTGGTAGTTCTTGTTAAGCCTTCAGGTGCGAGATGTT
ACGTTGATGGATCTGAAGAAATTGGAAGTGACTTTAAGATAAAATGTGAACCAAAAGAAGGTTCACTTCCATTACAGTATGAGTGGCAAAAATTG
TCTGACTCACAGAAAATGCCCACTTCATGGTTAGCAGAAATGACTTCATCTGTTATATCTGTAAAAAATGCCTCTTCTGAGTACTCTGGGACATA
CAGCTGTACAGTCAGAAACAGAGTGGGCTCTGATCAGTGCCTGTTGCGTCTAAACGTTGTCCCTCCTTCAAATAAAGCTGGACTAATTGCAGGA
GCCATTATAGGAACTTTGCTTGCTCTAGCGCTCATTGGTCTTATCATCTTTTGCTGTCGTAAAAAGCGCAGAGAAGAAAAATATGAAAAGGAAGT
TCATCACGATATCAGGGAAGATGTGCCACCTCCAAAGAGCCGTACGTCCACTGCCA<u>GAAGCTACATCGGCAGTAA</u>TCATTCATCCCTGGGGT
CCATGTCTCCTTCCAACATGGAAGGATATTCCAAGACTCAGTATAACCAAGTACCAAGTGAAGACTTTGAACGCACTCCTCAGAGTCCGACTCT
CCCACCTGCTAAGGTAGCTGCCCCTAATCTAAGTCGAATGGGTGCGATTCCTGTGATGATTCCAGCACAGAGCAAGGATGGGTCTATAGTATA
GAGCCTCCATATGTCTCATCTGTGCTCTCCGTGTTCCTTTCCTTTTTTTGATATATGAAAACCTATTCTGGTCTAAATTGTGTTACTAGCCTCAAA
ATACATCAAAAAATAAGTTAATCAGGAACTGTACGGAATATATTTTTAAAAATTTTTGTTTGGTTATATCGAAATAGTTACAGGCACTAAAGTTAGT
AAAGAAAAGTTTACCATCTGAAAAAGCTGGATTTTCTTTAAGAGGTTGATTATAAAGTTTTCTAAATTTATCAGTACCTAAGTAAGATGTAGCGCT
TTGAATATGAAATCATAGGTGAAGACATGGGTGAACTTACTTGCATACCAAGTTGATACTTGAATAACCATCTGAAAGTGGTACTTGATCATTTTT
ACCATTATTTTTAGGATGTGTATTTCATTTATTTATGGCCCACCAGTCTCCCCCAAATTAGTACAGAAATATCCATGACAAAATTACTTACGTATGT
TTGTACTTGGTTTTACAGCTCCTTTGAAAACTCTGTGTTTGGAATATCTCTAAAAACATAGAAAACACTACAGTGGTTTAGAAATTACTAATTTTAC
TTCTAAGTCATTCATAAACCTTGTCTATGAAATGACTTCTTAAATATTTAGTTGATAGACTGCTACAGGTAATAGGGACTTAGCAAGCTCTTTTATA
TGCTAAAGGAGCATCTATCAGATTAAGTTAGAACATTTGCTGTCAGCCACATATTGAGATGACACTAGGTGCAATAGCAGGGATAGATTTTGTTG
GTGAGTAGTCTCATGCCTTGAGATCTGTGGTGGTCTTCAAAATGGTGGCCAGCCAGATCAAGGATGTAGTATCTCATAGTTCCCAGGTGATATT
TTTCTTATTAGAAAAATATTATAACTCATTTGTTGTTTGACACTTATAGATTGAAATTTCCTAATTTATTCTAAATTTTAAGTGGTTCTTTGGTTCCA
GTGCTTTATGTTGTTGTTGTTTTTGGATGGTGTTACATATTATATGTTCTAGAAACATGTAATCCTAAATTTACCCTCTTGAATATAATCCCTGGAT
GATATTTTTTATCATAAATGCAGAATAATCAAATACATTTTAAGCAAGTTAAGTGTCCTCCATCAATTCTGTATTCCAGACTTGGGAGGATGTACA
GTTGCTGTTGTGTGATCAAACATGTCTCTGTGTAGTTCCAGCAAATCAAGCTGAGCTTTGAAAAAGTTTGTCTTAGTTTTGTGAAGGTGATTTATT
CTTAAAAAAAAAAAAAAAAAAAAAA (SEQ ID NO:201)

*Bold italics* indicates siRNA target region with biological activity
<u>Bold underlined</u> indicates siRNA target region with dose-dependent biological activity

FIGURE 183
PTK7 is Over-Expressed in Multiple Tumor Types

| | Overexpression $\Delta$+1 (% tumors) | Overexpression $\Delta$+2 (% tumors) |
|---|---|---|
| Prostate | 70% | 70% |
| Brain, Glioblastoma | 67% | 67% |
| Kidney | 50% | 50% |
| Colon | 60% | 10% |
| Bladder | 40% | 10% |
| Pancreas | 100% | - |
| Ovary | 10% | - |

PTK7 is Expressed in Hormone-Dependent and Hormone-Independent Prostate Xenografts

PTK7 Is Expressed in H1299 Lung Cell Line

FIGURE 186
PTK7 Expression Observed on 3D Tumor Spheroid Cells

3D Tumor Spheroid Cultures:
A Model for Cancer Stem Cells

- Proliferate slowly as a 3D spheroid structure *in vitro*, closely mimicking *in vivo* tumor growth
- Repopulation of adherent cell population gaining differentiation markers
- Preferentially express an array of stem-cell genes similar to those expressed by self-renewing stem cells
- Highly tumorigenic, suggesting a role in tumor initiation, development, and metastasis

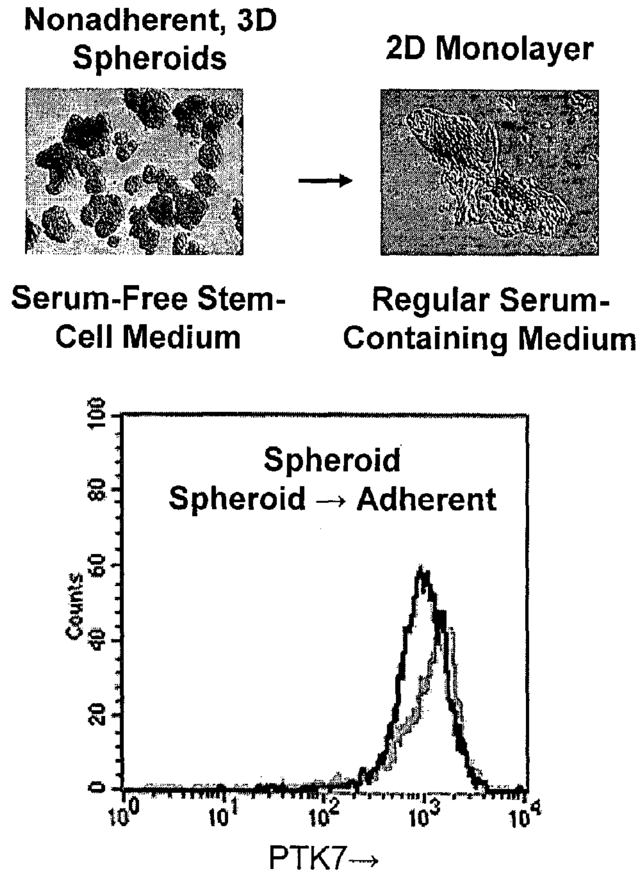

PTK7 mRNA Expression Analysis in Multiple Tumor Tissues

Knockdown of PTK7 (02-0262) mRNA Inhibits Proliferation in Multiple Cell Lines

* Reproducible 30% or greater decrease in proliferation

Knockdown of PTK7 (02-0262) mRNA Induces Apoptosis in Multiple Cancer Cell Lines

* Reproducible 50% or greater increase in apoptosis

Knockdown of PTK7 (02-0262) mRNA Inhibits Proliferation and Induces Apoptosis in H1299 Lung Cancer Cells Individual siRNA Duplexes Titration of Duplex 11

Knockdown of PTK7 (02-0262) mRNA Inhibits Proliferation in HCT116 Colon Cancer Cells Individual siRNA Duplexes Titration of Duplex 11

Anti-PTK7 (02-0262) Ab Blocked H1299 Lung Tumor Cell Line Proliferation

FIGURE 193
PTK7 Copy Number Increase by CGH

| | |
|---|---|
| 58.3% | cervical carcinoma cell lines |
| 29.2% | small-cell lung cancer |
| 26.1% | lung cancer cell lines |
| 15.0% | invasive ductal breast carcinomas |
| 12.5% | medulloblastoma cell lines |
| 12.0% | primary squamous cell carcinomas of the lung |
| 11.1% | pilocytic astrocytomas |
| 10.0% | advanced colorectal carcinoma metastases |
| 8.3% | primary cervical carcinomas |
| 6.8% | primary adenocarcinomas of the lung |
| 4.0% | metastasizing squamous cell carcinomas of the lung |
| 4.0% | invasive lobular breast carcinomas |
| 3.4% | metastasizing HNSCCs |

Threshold of 1.25, approximating trisomy in a 50% pure sample

Highest overall in cervical cell lines

Highest tissue: lung, also prevalent in br, di, ga

PTK7 Expression on 3D Spheroid Cells Derived from ACHN Kidney Cancer Cell Line

FIGURE 195
PTK7 Expression in LnCAP Xenograft Isolated Cells
Hormone Independent
ZRT017D, EpCAM+ gated, 2/15/06
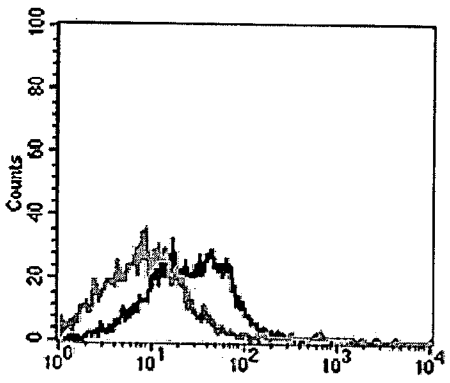
Hormone Independent
ZRT018D, 97% EpCAM+, 2/23/06
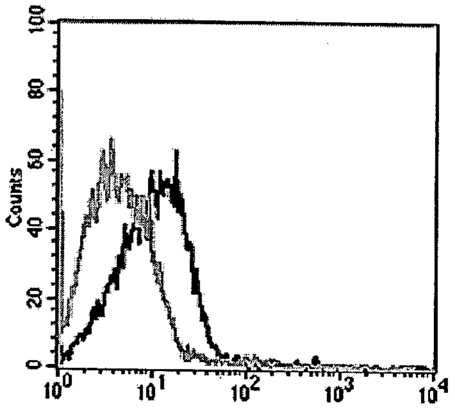
-------- Isotype
--------- PTK7

PTK7 is Expressed on Prostate Cell Lines as Measured by Flow Cytometry

PTK7 is Expressed by FACS on Prostate Cell Lines

FIGURE 198
PTK7 is Expressed on Prostate Cell Lines as Measured by Flow Cytometry

22RV1

CaHPV10

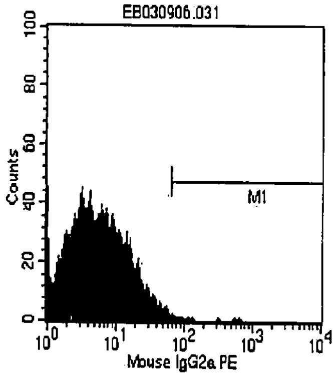

File: EB030906.031
Sample ID: 22RV1, p10
Acquisition Date: 09-Mar-06
Gate: G1
Gated Events: 8006
Total Events: 10000

| Marker | % Gated | % Total | Mean |
|---|---|---|---|
| All | 100.00 | 80.06 | 9.62 |
| M1 | 0.24 | 0.19 | 167.10 |

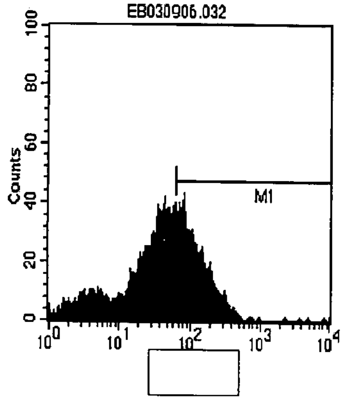

File: EB030906.032
Sample ID: 22RV1, p10
Acquisition Date: 09-Mar-06
Gate: G1
Gated Events: 7874
Total Events: 10000

| Marker | % Gated | % Total | Mean |
|---|---|---|---|
| All | 100.00 | 78.74 | 73.96 |
| M1 | 39.42 | 31.43 | 142.34 |

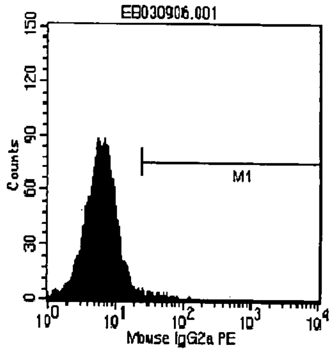

File: EB030906.001
Sample ID: CaHPV10, p10
Acquisition Date: 09-Mar-06
Gate: G1
Gated Events: 9286
Total Events: 10000

| Marker | % Gated | % Tota | Mean |
|---|---|---|---|
| All | 100.00 | 92.86 | 6.77 |
| M1 | 0.76 | 0.71 | 38.94 |

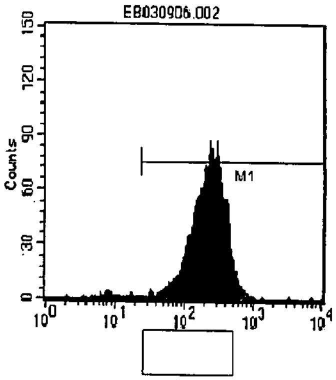

File: EB030906.002
Sample ID: CaHPV10, p10
Acquisition Date: 09-Mar-06
Gate: G1
Gated Events: 9173
Total Events: 10000

| Marker | % Gated | % Total | Mean |
|---|---|---|---|
| All | 100.00 | 91.73 | 240.64 |
| M1 | 99.45 | 91.23 | 241.79 |

FIGURE 199
PTK7 is Expressed on Prostate Cell Lines as Measured by Flow Cytometry

DU145

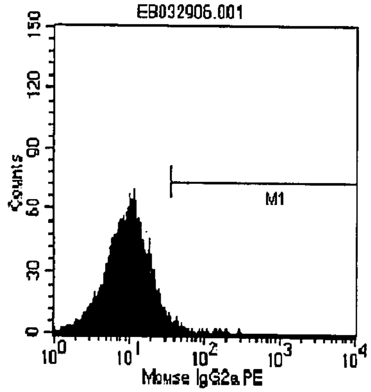

File: EB032906.001
Sample ID: DU145
Acquisition Date: 29-Mar-06
Gate: G1
Gated Events: 7907
Total Events: 10000

| Marker | % Gated | % Total | Mean |
|---|---|---|---|
| All | 100.00 | 79.07 | 10.82 |
| M1 | 0.81 | 0.64 | 55.13 |

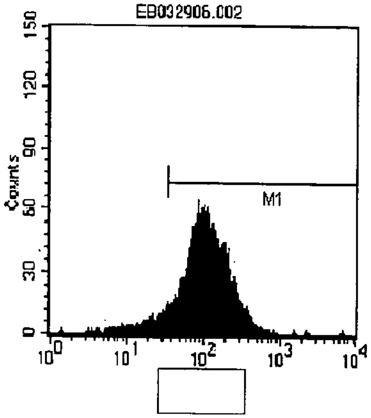

File: EB032906.002
Sample ID: DU145
Acquisition Date: 29-Mar-06
Gate: G1
Gated Events: 7970
Total Events: 10000

| Marker | % Gated | % Total | Mean |
|---|---|---|---|
| All | 100.00 | 79.70 | 122.89 |
| M1 | 92.61 | 73.81 | 130.88 |

LnCAP

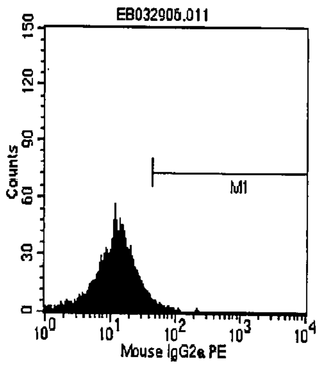

File: EB032906.011
Sample ID: LnCAP
Acquisition Date: 29-Mar-06
Gate: G1
Gated Events: 5425
Total Events: 10000

| Marker | % Gated | % Total | Mean |
|---|---|---|---|
| All | 100.00 | 54.25 | 14.73 |
| M1 | 2.12 | 1.15 | 58.38 |

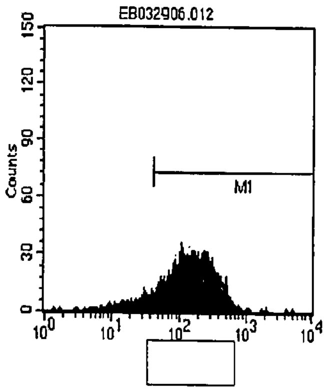

File: EB032906.012
Sample ID: LnCAP
Acquisition Date: 29-Mar-06
Gate: G1
Gated Events: 5470
Total Events: 10000

| Marker | % Gated | % Total | Mean |
|---|---|---|---|
| All | 100.00 | 54.70 | 182.87 |
| M1 | 90.51 | 49.51 | 199.12 |

FIGURE 200

PTK7 is Expressed on Prostate Cell Lines as Measured by Flow Cytometry

PC3

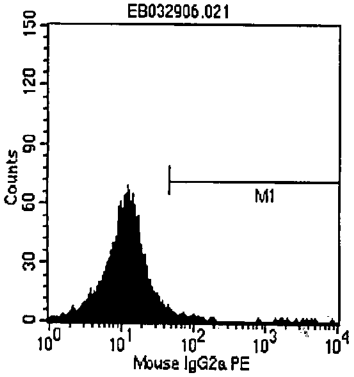

File: EB032906.021
Sample ID: PC3
Acquisition Date: 29-Mar-06
Gate: G1
Gated Events: 7316
Total Events: 10000

| Marker | % Gated | % Total | Mean |
|---|---|---|---|
| All | 100.00 | 73.16 | 17.94 |
| M1 | 1.75 | 1.28 | 311.42 |

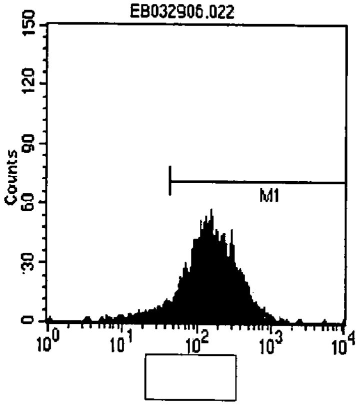

File: EB032906.022
Sample ID: PC3
Acquisition Date: 29-Mar-06
Gate: G1
Gated Events: 7683
Total Events: 10000

| Marker | % Gated | % Total | Mean |
|---|---|---|---|
| All | 100.00 | 76.83 | 196.76 |
| M1 | 93.15 | 71.57 | 209.12 |

RWPE1

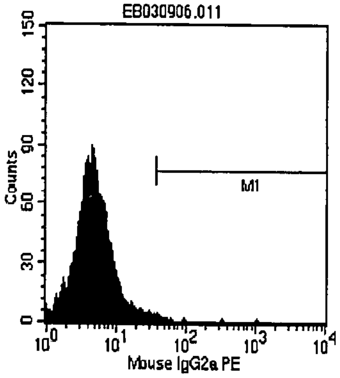

File: EB030906.011
Sample ID: RWPE-1, p13
Acquisition Date: 09-Mar-06
Gate: G1
Gated Events: 9183
Total Events: 10000

| Marker | % Gated | % Total | Mean |
|---|---|---|---|
| All | 100.00 | 91.83 | 5.83 |
| M1 | 0.33 | 0.30 | 84.32 |

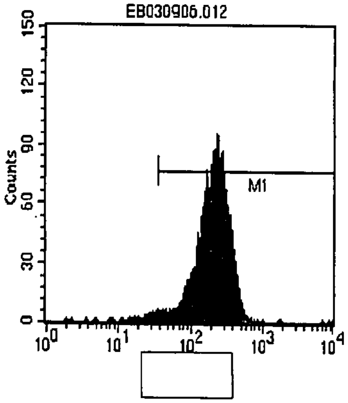

File: EB030906.012
Sample ID: RWPE-1, p13
Acquisition Date: 09-Mar-06
Gate: G1
Gated Events: 9064
Total Events: 10000

| Marker | % Gated | % Total | Mean |
|---|---|---|---|
| All | 100.00 | 90.64 | 220.17 |
| M1 | 98.49 | 89.27 | 223.15 |

FIGURE 201
PTK7 is Expressed on Prostate Cell Lines as Measured by Flow Cytometry
RWPE2
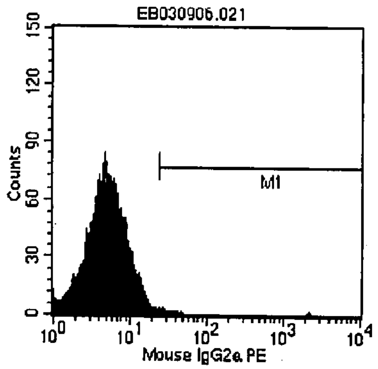
File: EB030906.021
Sample ID: RWPE-2
Acquisition Date: 09-Mar-06
Gate: G1
Gated Events: 9137
Total Events: 10000
| Marker | % Gated | % Total | Mean |
|---|---|---|---|
| All | 100.00 | 91.37 | 5.80 |
| M1 | 0.33 | 0.30 | 93.65 |
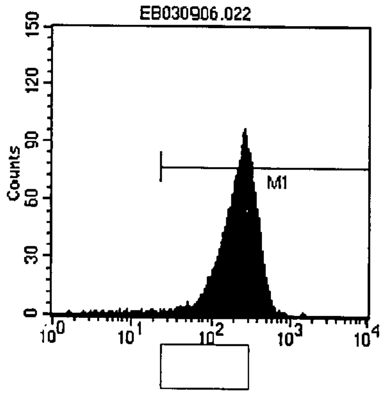
File: EB030906.022
Sample ID: RWPE-2
Acquisition Date: 09-Mar-06
Gate: G1
Gated Events: 9091
Total Events: 10000
| Marker | % Gated | % Total | Mean |
|---|---|---|---|
| All | 100.00 | 90.91 | 239.23 |
| M1 | 99.40 | 90.36 | 240.62 |

PTK7 mRNA Expression in Prostate Tumors and Normal Tissues Demonstrates 2 Populations in Prostate Tumors

PTK7 Expression in 3D Tumor Spheroid Cells Derived from Kidney and Lung Cancer Cell Lines

Copy Number Increase by CGH

Threshold of 1.25, approximating trisomy in a 50% pure sample

FIGURE 205
mRNA sequence of PTK7

GCGGCGCGCGGGGACTCGGAGGTACTGGGCGCGCGCGGCTCCGGCTCGGGACGCCTCGGGACGCCTCGGGGTCGGGCTCCGGCTGCGGCTGCTGCTGCGGCGCCCGCGCTCCGGT
GCGCTCCGCCTCCTGTGCCCGCCGCGGAGCGCAGTCTGCGCGCCCGCCGTGCGCCCTCAGCTCCTTTTCCTGAGCCCGCCGCGATGGGAGCTGCGCGGGGATCCCCGGCCAGACCCC
GCCGGTTGCCTCTGCTCAGCGTCCTGCTGCTGCCGCTGCTGGGCGGTACCCAGACAGCCATTGTCTTCATCAAGCAGCCGTCCTCCCAGGATGCACTGCAGGGGCGCCGGGCGCTGCT
TCGCTGTGAGGTTGAGGCTCCGGGCCCGGTACATGTGTACTGGCTGCTCGATGGGGCCCCTGTCCAGGACACGGAGCGGCGTTTCGCCCAGGGCAGCAGCCTGAGCTTTGCAGCTGTG
GACCGGCTGCAGGACTCTGGCACCTTCCAGTGTGTGGCTCGGGATGATGTCACTGGAGAAGAAGCCCGCAGTGCCAACGCCTCCTTCAACATCAAATGGATTGAGGCAGGTCCTGTGGT
CCTGAAGCATCCAGCCTCGGAAGCTGAGATCCAGCCACAGACCCAGGTC*ACACTTCGTTGCCACATTG*ATGGGCACCCTCGGCCCACCTACCAATGGTTCCGAGATGGGACCCCCCTTT
CTGATGGTCAGAGCAACCACACAGTCAGCAGCAAGGAGCGGAACCTGACGCTCCGGCCAGCTGGTCCT*GAGCATAGTGGGCTGTATT*CCTGCTGCGCCCACAGTGCTTTTGGCCAGGCT
TGCAGCAGCCAGAACTTCACCTTGAGCATTGCTGATGAAAGCTTTGCCAGGGTGGTGCTGGCACCCCAGGACGTGGTAGTAGCGAGGTATGAGGAGGCCATGTTCCATTGCCAGTTCTCA
GCCCAGCCACCCCCGAGCCTGCAGTGGCTCTTTGAGGATGAGACTCCCATCACTAACCGCAGTCGCCCCCCACACCT*CCGCAGAGCCACAGTGTTT*GCCAACGGGTCTCTGCTGCTGAC
CCAGGTCCGGCCACGCAATGCAGGGATCTACCGCTGCATTGGCCAGGGGCAGAGGGGCCCACCCATCATCCTGGAAGCCACACTTCACCTAGCAGAGATTGAAGACATGCCGCTATTTG
AGCCACGGGTGTTTACAGCTGGCAGCGAGGAGCGTGTGACCTGCCTTCCCCCCAAGGGTCTGCCAGAGCCCAGCGTGTGGTGGGAGCACGCGGGAGTCCGGCTGCCCACCCATGGCA
GGGTCTACCAGAAGGGCCACGAGCTGGTGTTGGCCAATATTGCTGAAAGTGATGCTGGTGTCTACACCTGCCACGCGGCCAACCTGGCTGGTCAGCGGAGACAGGATGTCAACATCACT
GTGGCCACTGTGCCCTCCTGGCTGAAGAAGCCCCAAGACAGCCAGCTGGAGGAGGGCAAACCCGGCTACTTGGATTGCCTGACCCAGGCCACACCAAAACCTACAGTTGTCTGGTACAG
AAACCAGATGCTCATCTCAGAGGACTCACGGTTCGAGGTCTTCAAGAATGGGACCTTGCGCATCAACAGCGTGGAGGTGTATGATGGGACATGGTACCGTTGTATGAGCAGCACCCCAGC
CGGCAGCATCGAGGCGCAAGCCCGTGTCCAAGTGCTGGAAAAGCTCAAGTTCACACCACCACCCCAGCCACAGCAGTGCATGGAGTTTGACAAGGAGGCCACGGTGCCCTGTTCAGCCA
CAGGCCGAGAGAAGCCCACTATTAAGTGGGAACGGGCAGATGGGAGCAGCCTCCCAGAGTGGGTGACAGACAACGCTGGGACCCTGCATTTTGCCCGGGTGACTCGAGATGACGCTGG
CAACTACACTTGCATTGCCTCCAACGGGCCGCAGGGCCAGATTCGTGCCCATGTCCAGCTCACTGTGGCAGTTTTTATCACCTTCAAAGTGGAACCAGAGCGTACGACTGTGTACCAGGG
CCACACAGCCCTACTGCAGTGCGAGGCCCAGGGGGACCCCAAGCCGCTGATTCAGTGGAAAGGCAAGGACCGCATCCTGGACCCCACCAAGCTGGGACCCAGGATGCACATCTTCCAG
AATGGCTCCCTGGTGATCCATGACGTGGCCCCTGAGGACTCAGGCCGCTACACCTGCATTGCAGGCAACAGCTGCAACATCAAGCACACGGAGGCCCCCCTCTATGTCGTGGACAAGCC
TGTGCCGGAGGAGTCGGAGGGCCCTGGCAGCCCTCCCCCCTACAAGATGATCCAGACCATTGGGTTGTCGGTGGGTGCCGCTGTGGCCTACATCATTGCCGTGCTGGGCCTCATGTTCT
ACTGCAAGAAGCGCTGCAAAGCCAAGCGGCTGCAGAAGCAGCCCGAGGGCGAGGAGCCAGAGATGGAATGCCTCAACGGTGGGCCTTTGCAGAACGGGCAGCCCTCAGCAGAGATCC
AAGAAGAAGTGGCCTTGACCAGCTTGGGCTCCGGCCCCGCGGCCACCAACAAACGCCACAGCACAAGTGATAAGATGCACTTCCCACGGTCTAGCCTGCAGCCCATCACCACGCTGGGG
AAGAGTGAGTTTGGGGAGGTGTTCCTGGCAAAGGCTCAGGGCTTGGAGGAGGGAGTGGCAGAGACCCTGGTACTTGTGAAGAGCCTGCAGAGCAAGGATGAGCAGCAGCAGCTGGACT
TCCGGAGGGAGTTGGAGATGTTTGGGAAGCTGAACCACGCCAACGTGGTGCGGCTCCTGGGGCTGTGCCGGGAGGCTGAGCCCCACTACATGGTGCTGGAATATGTGGATCTGGGAGA
CCTCAAGCAGTTCCTGAGGATTTCCAAGAGCAAGGATGAAAAATTGAAGTCACAGCCCCTCAGCACCAAGCAGAAGGTGGCCCTATGCACCCAGGTAGCCCTGGGCATGGAGCACCTGTC
CAACAACCGCTTTGTGCATAAGGACTTGGCT<u>GCGCGTAACTGCCTGGTCA</u>GTGCCCAGAGACAAGTGAAGGTGTCTGCCCTGGGCCTCAGCAAGGATGTGTACAACAGTGAGTACTACCA
CTTCCGCCAGGCCTGGGTGCCGCTGCGCTGGATGTCCCCCGAGGCCATCCTGGAGGGTGACTTCTCTACCAAGTCTGATGTCTGGGCCTTCGGTGTGCTGATGTGGGAAGTGTTTACAC
ATGGAGAGATGCCCCATGGTGGGCAGGCAGATGATGAAGTACTGGCAGATTTGCAGGCTGGGAAGGCTAGACTTCCTCAGCCCGAGGGCTGCCCTTCCAAACTCTATCGGCTGATGCAG
CGCTGCTGGGCCCTCAGCCCCAAGGACCGGCCCTCCTTCAGTGAGATTGCCAGCGCCCTGGGAGACAGCACCGTGGACAGCAAGCCGTGAGGAGGGAGCCCGCTCAGGATGGCCTGG
GCAGGGGAGGACATCTCTAGAGGGAAGCTCACAGCATGATGGGCAAGATCCCTGTCCTCCTGGGCCCTGAGGCCCCTGCCCTAGTGCAACAGGCATTGCTGAGGTCTGAGCAGGGCCT
GGCCTTTCCTCCTCTTCCTCACCCTCATCCTTTGGGAGGCTGACTTGGACCCAAACTGGGCGACTAGGGCTTTGAGCTGGGCAGTTTTCCCTGCCACCTCTTCCTCTATCAGGGACAGTGT
GGGTGCCACAGGTAACCCCAATTTCTGGCCTTCAACTTCTCCCCTTGACCGGGTCCAACTCTGCCACTCATCTGCCAACTTTGCCTGGGGAGGGCTAGGCTTGGGATGAGCTGGGTTTGT
GGGGAGTTCCTTAATATTCTCAAGTTCTGGGCACACAGGGTTAATGAGTCTCTTGGCCCACTGGTCCCACTTGGGGGTCTAGACCAGGATTATAGAGGACACAGCAAGTGAGTCCTCCCCA
CTCTGGGCTTGTGCACACTGACCCAGACCCACGTCTTCCCCACCCTTCTCTCCTTTCCTCATCCTAAGTGCCTGGCAGATGAAGGAGTTTTCAGGAGCTTTTGACACTATATAAACCGCCCT
TTTTGTATGCACCACGGGCGGCTTTTATATGTAATTGCAGCGTGGGGTGGGTGGGCATGGGAGGTAGGGGTGGGCCCTGGAGATGAGGAGGGTGGGCCATCCTTACCCCACACTTTTAT
TGTTGTCGTTTTTTGTTTGTTTTGTTTTTTTGTTTTTGTTTTTGTTTTTACACTCGCTGCTCTCAATAAATAAGCCTTTTTTACAACCTG (SEQ ID NO:202)

*Bold italics* indicates siRNA target region with biological activity

<u>Bold underlined</u> indicates siRNA target region with dose-dependent biological activity

FIGURE 206
MISTR is Over-Expressed in Multiple Tumor Types

| | Over-expression (% tumors) | |
|---|---|---|
| | Δ+1 | Δ+2 |
| Metastatic Pancreas | 100 | 100 |
| Ovary | 90 | 90 |
| Liver | 75 | 75 |
| Colon | 70 | 70 |
| Breast | 70 | 50 |
| Pancreas | 38 | 38 |

- Expressed in 7 / 10 lung tumor specimens

MISTR mRNA Expression Analysis in Multiple Tumor Tissues

- Elevated mRNA expression observed in pancreatic, colon and ovarian tumors

Knockdown of MISTR (04-0185) mRNA Inhibits Proliferation in Pancreas, Lung, Colon, Kidney and Gastric Cancer Cells

* Reproducible 35% or greater decrease in proliferation

Knockdown of MISTR (04-0185) mRNA Induces Apoptosis in Pancreas, Lung and Colon Cancer Cells

* Reproducible 50% or greater increase in apoptosis

Knockdown of MISTR (04-0185) mRNA Inhibits Proliferation in HCT116 Colon Cancer Cells Individual siRNA Duplexes Titration of Duplex 8

Knockdown of MISTR (04-0185) mRNA Inhibits Proliferation in MPANC96 Pancreatic Cancer Cells Individual siRNA Duplexes Titration of Duplex 8

Anti-MISTR (04-0185) Polyclonal Antibody Inhibits Proliferation in Lung Cancer Cells

FIGURE 213
mRNA sequence of MISTR

GGATCCTCTAGGGTCCCAGCTCGCCTCGATGGAGCTCCTCCCGCCGCTGCCTCAGTCCTTCCTGTTGCTGCTGCTGTTGCCTGCCAAGCCCGCGGCGGGCGAGGACTGGCAGTGCCCGCGC
ACCCCCTACGCGGCCTCTCGCGACTTTGACGTGAAGTACGTGGTGCCCAGCTTCTCCGCCGGAGGCCTGGTACAGGCCATGGTGACCTACGAGGGCGACAGAAATGAGAGTGCTGTGTTTGT
AGCCATACGCAATCGCCTGCATGTGCTTGGGCCTGACCTGAAGTCTGTCCAGAGCCTGGCCACGGGCCCTGCTGGAGACCCTGGCTGCCAGACGTGTGCAGCCTGTGGCCCAGGACCCCAC
GGCCCTCCCGGTGACACAGACACAAAGGTGCTGGTGCTGGATCCCGCGCTGCCTGCGCTGGTCAGTTGTGGCTCCAGCCTGCAGGGCCGCTGCTTCCTGCATGACCTAGAGCCCCAAGGGA
CAGCCGTGCATCTGGCAGCGCCAGCCTGCCTCTTCTCAGCCCACCATAACCGGCCCGATGACTGCCCCGACTGTGTGGCCAGCCCATTGGGCACCCGTGTAACTGTGGTTGAGCAAGGCCAG
GCCTCCTATTTCTACGTGGCATCCTCACTGGACGCAGCCGTGGCTGGCAGCTTCAGCCCACGCTCAGTGTCTATCAGGCGTCTCAAGGCTGACGCCTCGGGATTCGCACCGGGCTTTGTGGCG
TTGTCAGTGCTGCCCAAGCATCTTGTCTCCTACAGTATTGAATACGTGCACAGCTTCCACACGGGAGCCTTCGTATACTTCCTGACTGTACAGCCGGCCAGCGTGACAGATGATCCTAGTGCCC
TGCACACACGCCTGGCACGGCTTAGCGCCACTGAGCCAGAGTTGGGTGACTATCGGGAGCTGGTCCTCGACTGCAGATTTGCTCCAAAACGCAGGCGCCGGGGGGCCCCAGAAGGCGGACA
GCCCTACCCTGTGCTGCAGGTGGCCCACTCCGCTCCAGTGGGTGCCCAACTTGCCACTGAGCTGAGCATCGCCGAGGGCCAGGAAGTACTATTTGGGGTCTTTGTGACTGGCAAGGATGGTG
GTCCTGGCGTGGGCCCCAACTCTGTCGTCTGTGCCTTCCCCATTGACCTGCTGGACACACTAATTGATGAGGGTGTGGAGCGCTGTTGTGAATCCCCAGTCCATCCAGGCCTCCGGCGAGGCC
TCGACTTCTTCCAGTCGCCCAGTTTTTGCCCCAACCCGCCTGGCCTGGAAGCCCTCAGCCCCAACACCAGCTGCCGCCACTTCCCTCTGCTGGTCAGTAGCAGCTTCTCACGTGTGGACCTATT
CAATGGGCTGTTGGGACCAGTACAGGTCACTGCATTGTATGTGACACGCCTTGACAACGTCACAGTGGCACACATGGGCACAATGGATGGGCGTATCCTGCAGGTGGAGCTGGTCAGGTCACT
AAACTACTTGCTGTATGTGTCCAACTTCTCACTGGGTGACAGTGGGCAGCCCGTGCAGCGGGATGTCAGTCGTCTTGGGGACCACCTACTCTTTGCCTCTGGGGACCAGGTTTTCCAGGTACCT
ATCCGAGGCCCTGGCTGCCGCCACTTCCTGACCTGTGGGCGTTGCCTAAGGGCATGGCATTTCATGGGCTGTGGCTGGTGTGGGAACATGTGCGGCCAGCAGAAGGAGTGTCCTGGCTCCTG
GCAACAGGACCACTGCCCACCTAAGCTTACTGAGTTCCACCCCCACAGTGGACCTCTAAGGGGCAGTACAAGGCTGACCCTGTGTGGCTCCAACTTCTACCTTCACCCTTCTGGTCTGGTGCCT
GAGGGAACCCATCAGGTCACTGTGGGCCAAAGTCCCTGCCGGCCACTGCCCAAGGACAGCTCAAAACTCAGACCAGTGCCCCGGAAAGACTTTGTAGAGGAGTTTGAGTGTGAACTGGAGCC
CTTGGGCACCCAGGCAGTGGGGCCTACCAACGTCAGCCTCACCGTGACTAACATGCCACCGGGCAAGCACTTCCGGGTAGACGGCACCTCCGTGCTGAGAGGCTTCTCTTTCATGGAGCCAG
TGCTGATAGCAGTGCAACCCCTCTTTGGCCCACGGGCAGGAG*GCACCTGTCTCACTCTTGA*AGGCCAGAGTCTGTCTGTAGGCACCAGCCGGGCTGTGCTGGTCAATGGGACTGAGTGTCTG
CTAGCACGGGTCAGTGAGGGGCAGCTTTTATGTGCCACACCCCCTGGGGCCACGGTGGCCAGTGTCCCCCTTAGCCTGCAGGTGGGGGGTGCCCAGGTACCTGGTTCCTGGACCTTCCAGTA
CAGAGAAGACCCTGTCGTGCTAAGCATCAGCCCCAACTGTGGCTACATCAACTCCCACATCACCATCTGTGGCCAGCATCTAACTTCAGCATGGCACTTAGTGCTGTCATTCCATGACGGGCTT
AGGGCAGTGGAAAGCAGGTGTGAGAGGCAGCTTCCAGAGCAGCAGCTGTGCCGCCTTCCTGAATATGTGGTCCGAGACCCCCAGGGATGGGTGGCAGGGAATCTGAGTGCCCGAGGGGATG
GAGCTGCTGGCTTTACACTGCCTGGCTTTCGCTTCCTACCCCCACCCCATCCACCCAGTGCCAACCTAGTTCCACTGAAGCCTGAGGAGCATGCCATTAAGTTTGAGTATATTGGGCTGGGCGC
TGTGGCTGACTGTGTGGGTATCAACGTGACCGTGGGTGGTGAGAGCTGCCAGCACGAGTTCCGGGGGGACATGGTTGTCTGCCCCCTGCCCCCATCCCTGCAGCTTGGCCAGGATGGTGCC
CCATTGCAGGTCTGCGTAGATGGTGAATGTCATATCCTGGGTAGAGTGGTGCGGCCAGGGCCAGATGGGGTCCCACAGAGCACGCTCCTTGGTATCCTGCTGCCTTTGCTGCTGCTTGTGGCT
GCACTGGCGACTGCACTGGTCTTCAGCTACTGGTGGCGGAGGAAGCAGCTAGTTCTTCCTCCCAACCTGAATGACCTGGCATCCCTGGACCAGACTGCTGGAGCCACACCCCTGCCTATTCTG
TACTCGGGCTCTGACTACAGAAGTGGCCTTGCACTCCCTGCCATTGATGGTCTGGATTCCACCACTTGTGTCCATGGAGCATCCTTCTCCGATAGTGAAGATGAATCCTGTGTGCCACTGCTGC
GGAAAGAGTCCATCCAGCTAAGGGACCTGGACTCTGCGCTCTTGGCTGAGGTCAAGGATGTGCTGATTCCCCATGAGCGGGTGGTCACCCACAGTGACCGAGTCATTGGCAAAGGCCACTTT
GGAGTTGTCTACCACGGAGAATACATAGACCAGGCCCAGAATCGAATCCAATGTGCCATCAAGTCACTAAGTCGCATCACAGAGATGCAGCAGGTGGAGGCCTTCCTGCGAGAGGGGCTGCTC
ATGCGTGGCCTGAACCACCCGAATGTGCTGGCTCTCATTGGTATCATGTTGCCACCTGAGGGCCTGCCCCATGTGCTGCTGCCCTATATGTGCCACGGTGACCTGCTCCAGTTCATCCGCTCAC
CTCAGCGGAACCCCACCGTGAAGGACCTCATCAGCTTTGGCCTGCAGGTAGCCCGCGGCATGGAGTACCTGGCAGAGCAGAAGTTTGTGCACAGGGACCTGGCTGCGCGGAACTGCATGCT
GGACGAGTCATTCACAGTCAAGGTGGCTGACTTTGGTTTGGCCCGCGACATCCTGGACAG*GGAGTACTATAGTGTTCAA*CAGCATCGCCACGCTCGCCTACCTGTGAAGTGGATGGCGCTGG
AGAGC*CTGCAGACCTATAGATTTA*CCACCAAGTCTGATGTGTGGTCATTTGGTGTGCTGCTGTGGGAACTGCTGACACGGGGTGCCCCACCATACCGCCACATTGACCCTTTTGACCTTACCCA
CTTCCTGGCCCAGGGTCGGCGCCTGCCCCAGCCTGAGTATTGCCCTGATTCTCTGTACCAAGTGATGCAGCAATGCTGGGAGGCAGACCCAGCAGTGCGACCCACCTTCAGAGTACTAGTGG
GGGAGGTGGAGCAGATAGTGTCTGCACTGCTTGGGGACCATTATGTGCAGCTGCCAGCAACCTACATGAACTTGGGCCCCAGCACCTCGCATGAGATGAATGTGCGTCCAGAACAGCCGCAG
TTCTCACCCATGCCAGGGAATGTACGCCGGCCCCGGCCACTCTCAGAGCCTCCTCGGCCCACTTGACTTAGTTCTTGGGCTGGACCTGCTTAGCTGCCTTGAGCTAACCCCAAGGCTGCCTCT
GGGCCATGCCAGGCCAGAGCAGTGGCCCTCCACCTTGTTCCTGCCCTTTAACTTTCAGAGGCAATAGGTAAATGGGCCCATTAGGTCCCTCACTCCACAGAGTGAGCCAGTGAGGGCAGTCCT
GCAACATGTATTTATGGAGTGCCTGCTGTGGACCCTGTCTTCTGGGCACAGTGGACTCAGCAGTGACCACACCAACACTGACCCTTGAACCAATAAAGGAACAAATGACTATTAAAGCACAAAAA
AAAAA (SEQ ID NO:203)

*Bold italics* indicates siRNA target region with biological activity

Bold underlined indicates siRNA target region with dose-dependent biological activity

METHODS AND COMPOSITIONS FOR TREATING AND DIAGNOSING DISEASE

FIELD OF THE INVENTION

This invention relates to the fields of molecular biology and oncology. Specifically, the invention provides molecular markers and therapeutic agents for use in the diagnosis and treatment of diseases, especially cancer. In particular, the invention provides the following targets and methods of using these targets: GFRa1, Claudin-4, ASCT2, CD166-ALCAM, CD55, TG2, CD49f, CD98, CD104, DPEP1, Tissue Factor (TF), Na-K ATPase beta3, VIPR1, CD26, CXADR, PTK7, and MISTR (see Figures), which are collectively referred to herein as "CAT" (cancer-associated targets).

BACKGROUND OF THE INVENTION

Cancer currently constitutes the second most common cause of death in the United States, and cancer is difficult to diagnose and treat effectively. Accordingly, there is a need in the art for improved methods for detecting and treating various cancers. The present invention fulfills these needs and further provides other related advantages, such as uses related to the treatment of other diseases.

Breast Cancer

Breast cancer is the primary killer of women. One in eight American women will develop breast cancer in her lifetime. An estimated 3 million women in the U.S. today are living with breast cancer, which 2 million have been diagnosed with the disease and 1 million have the disease but do not yet know it.

The incidence of breast cancer in the U.S. has more than doubled in the past 30 years. In 1964, the lifetime risk was one in twenty. Today it's one in eight. Breast cancer is the most commonly diagnosed cancer in women in both America and worldwide. One or more of a variety of treatments such as surgery, radiotherapy, chemotherapy and hormone therapy are used. The treatment course for a certain type of breast cancer is usually selected based on a various prognostic parameters, for example, an analysis of specific tumor markers. (e.g. Porter-Jordan and Lippman, Breast Cancer 8:73-100 (1994)). However, the use of established markers is insufficient to interpret the results and it still results in high mortality which is observed in breast cancer patients. Despite considerable research into therapies for these and other cancers, breast cancer remains difficult to diagnose and treat effectively. Accordingly, there is a need in the art for improved methods for detecting and treating such cancers.

Lung Cancer

Lung cancer is the second most prevalent type of cancer for both men and women in the United States and is the most common cause of cancer death in both sexes. Lung cancer can result from a primary tumor originating in the lung or a secondary tumor which has spread from another organ such as the bowel or breast. The five-year survival rate for lung cancer continues to be poor at 8-15% survival indicating a large unmet need with regard to more effective treatments and better diagnosis. The estimated total lung cancer deaths in the U.S. in 2003 are 157,200 and the total estimated new cases in 2003 are 171,900. Primary lung cancer is divided into three main types; small cell lung cancer; non-small cell lung cancer; and mesothelioma. Small cell lung cancer is also called "Oat Cell" lung cancer because the cancer cells are a distinctive oat shape. There are three types of non-small cell lung cancer. These are grouped together because they behave in a similar way and respond to treatment differently to small cell lung cancer. The three types are squamous cell carcinoma, adenocarcinoma, and large cell carcinoma. Squamous cell cancer develops from the cells that line the airways. Adenocarcinoma also develops from the cells that line the airways. However, adenocarcinoma develops from a particular type of cell that produces mucus (phlegm). Large cell lung cancer has been thus named because the cells look large and rounded when they are viewed under a microscope. Mesothelioma is a rare type of cancer which affects the covering of the lung called the pleura. Mesothelioma is often caused by exposure to asbestos.

Secondary lung cancer is cancer that has started somewhere else in the body (for example, the breast or bowel) and spread to the lungs. Choice of treatment for secondary lung cancer depends on where the cancer started. In other words, cancer that has spread from the breast should respond to breast cancer treatments and cancer that has spread from the bowel should respond to bowel cancer treatments.

The stage of a cancer indicates how far a cancer has spread. Staging is important because treatment is often decided according to the stage of a cancer. The staging is different for non-small cell and for small cell cancers of the lung.

Non-small cell cancer can be divided into four stages. Stage I is very localized cancer with no cancer in the lymph nodes. Stage II cancer has spread to the lymph nodes at the top of the affected lung. Stage III cancer has spread near to where the cancer started. This can be to the chest wall, the covering of the lung (pleura), the middle of the chest (mediastinum) or other lymph nodes. Stage IV cancer has spread to another part of the body.

Since small cell lung cancer can spread quite early in development of the disease, small cell lung cancers are divided into only two groups. These are: limited disease, that is cancer that can only be seen in one lung and in nearby lymph nodes; and extensive disease, that is cancer that has spread outside the lung to the chest or to other parts of the body. Further, even if spreading is not apparent on the scans, it is likely that some cancer cells will have broken away and traveled through the bloodstream or lymph system. To be safe, it is therefore preferred to treat small cell lung cancers as if they have spread, whether or not secondary cancer is visible. Because surgery is not typically used to treat small cell cancer, except in very early cases, the staging is not as critical as it is with some other types of cancer. Chemotherapy with or without radiotherapy is often employed. The scans and tests done at first will be used later to see how well a patient is responding to treatment.

Procedures used for detecting, diagnosing, monitoring, staging, and prognosticating lung cancer are of critical importance to the outcome of the patient. For example, patients diagnosed with early lung cancer generally have a much greater five-year survival rate as compared to the survival rate for patients diagnosed with distant metastasized lung cancer. New diagnostic methods which are more sensitive and specific for detecting early lung cancer are clearly needed.

Lung cancer patients are closely monitored following initial therapy and during adjuvant therapy to determine response to therapy and to detect persistent or recurrent disease of metastasis. There is clearly a need for a lung cancer marker which is more sensitive and specific in detecting lung cancer, its recurrence, and progression.

Another important step in managing lung cancer is to determine the stage of the patient's disease. Stage determination has potential prognostic value and provides criteria for designing optimal therapy. Generally, pathological staging of lung cancer is preferable over clinical staging because the former gives a more accurate prognosis. However, clinical staging would be preferred were it at least as accurate as pathological staging because it does not depend on an invasive procedure to obtain tissue for pathological evaluation. Staging of lung cancer would be improved by detecting new markers in cells, tissues, or bodily fluids which could differentiate between different stages of invasion.

Pancreatic Cancer

The prognosis for pancreatic carcinoma is, at present, very poor. Pancreatic cancer displays the lowest five-year survival rate among all cancers. Such prognosis results primarily from delayed diagnosis, due in part to the fact that the early symptoms are shared with other more common abdominal ailments. Despite the advances in diagnostic imaging methods like ultrasonography (US), endoscopic ultrasonography (EUS), dualphase spiral computer tomography (CT), magnetic resonance imaging (MRT), endoscopic retrograde cholangiopancreatography (ERCP) and transcutaneous or EUS-guided fine-needle aspiration (FNA), distinguishing pancreatic carcinoma from benign pancreatic diseases, especially chronic pancreatitis, is difficult because of the similarities in radiological and imaging features and the lack of specific clinical symptoms for pancreatic carcinoma.

Substantial efforts have been directed to developing tools useful for early diagnosis of pancreatic carcinomas. Nonetheless, a definitive diagnosis is often dependent on exploratory surgery which is inevitably performed after the disease has advanced past the point when early treatment may be effected.

Colon Cancer

The prognosis of colon cancer is directly related to the degree of penetration of the tumor through the bowel wall and the presence or absence of nodal involvement, consequently, early detection and treatment are especially important. Currently, diagnosis is aided by the use of screening assays for fecal occult blood, sigmoidoscopy, colonoscopy and double contrast barium enemas. Treatment regimens are determined by the type and stage of the cancer, and include surgery, radiation therapy and/or chemotherapy. Recurrence following surgery (the most common form of therapy) is a major problem and is often the ultimate cause of death. In spite of considerable research into therapies for the disease, colon cancer remains difficult to diagnose and treat. In spite of considerable research into therapies for these and other cancers, colon cancer remains difficult to diagnose and treat effectively. Accordingly, there is a need in the art for improved methods for detecting and treating such cancers.

Prostate Cancer

Prostate diseases include, for example, prostate cancer, as well as benign prostatic hyperplasia (BPH) and prostatitis.

Prostate cancer is the most common non-skin cancer in the United States, where one in six American men develop prostate cancer during his lifetime. About 80% of prostate cancers are diagnosed in men over the age of 65. African-American men are 65% more likely to develop prostate cancer than Caucasian-American men and, furthermore, African-American men tend to get more severe forms of prostate cancer and are more than twice as likely to die from prostate cancer as are Caucasian-American men. Approximately 25% of men with prostate cancer have a family history of prostate cancer. The risk of prostate cancer doubles among men having a first-degree relative with the disease; with two close relatives, a man's risk increases fivefold; and with three or more close relatives, the risk for developing prostate cancer is almost 100%.

Screening for prostate cancer is typically carried out using the prostate specific antigen (PSA) blood test and the digital rectal exam (DRE). The DRE and PSA test cannot confirm whether or not prostate cancer is present, but can indicate whether further testing is needed. If either the DRE or the PSA test indicates the presence of prostate cancer, a transrectal ultrasound (TRUS)-guided biopsy is typically carried out. A biopsy is the only way to confirm or diagnose the presence of prostate cancer. During a biopsy, a TRUS is used to view and guide one or more needles into the prostate to take multiple small samples of tissue from different parts of the prostate. These tissue samples are then examined for the presence of cancer in order to generate a value known as a Gleason Grade, which characterizes the aggressiveness of a particular prostate tumor based on the microscopic appearance of the tissue. Prostate cancer is also staged, which is an assessment of the size and degree of metastases of prostate cancer, using either of two different staging systems (a traditional system classifies the disease into four clinical categories rated A through D; another system exists which is called TNM staging for Tumor-Nodes-Metastases staging). The major treatment options for prostate cancer include hormonal therapy, surgery, radiation therapy, and chemotherapy. Early detection of prostate cancer increases the success rate of these treatment options.

Stomach (Gastric) Cancer

Stomach diseases (also known as gastric diseases) include, for example, stomach cancer and ulcers (ulcers typically involve a break in the tissue lining the stomach).

Stomach cancer is the second most common cancer in the world, behind only skin cancer. Stomach cancer occurs twice as often in men as women and is the most prevalent carcinoma in East Asia, with the rate in Japan being more than seven times that in the United States and accounting for one-third of all cancer deaths in Japan. The average age of individuals afflicted by stomach cancer is 55 years of age.

Several different types of stomach cancer exist. Adenocarcinomas are the most common type of stomach cancer, accounting for 90-95% of malignant tumors of the stomach. Adenocarcinomas typically develop from the epithelial cells that form the innermost lining of the stomach's mucosa. Soft tissue sarcomas are another type of stomach cancer, and soft tissue sarcomas typically develop from the cells of the muscle layer of the stomach. Leiomyosarcoma is the most common type of soft tissue sarcoma that affects the stomach. Another type of sarcoma that can affect the stomach is a gastrointestinal stromal tumor (GIST). Lymphomas can also affect the stomach, of which MALT (mucosa-associated lymphoid tissue) lymphoma is the most common type of lymphoma that affects the stomach. The stomach can also be affected by carcinoid tumors.

Stomach cancer can be diagnosed by an upper gastrointestinal (GI) series, which are x-rays of the esophagus and stomach taken after the patient has drinken a barium solution. Alternatively, an endoscopy can be carried out in which a tube is passed through the esophagus into the stomach and, if desired, a biopsy can be done to obtain a tissue sample for laboratory analysis. Blood tests, chest x-rays, a CT scan of the abdomen, and a check for blood in the patient's stools may also be carried out. Treatment for stomach cancer can include a combination of surgery (termed "gastrectomy"), chemotherapy, and radiation therapy. If the tumor is located close to the small intestine, a partial gastrectomy may be carried out in which a portion of the stomach is removed. If the tumor is located closer to the esophagus, a near-total gastrectomy may be carried out.

Stomach cancer is staged based on how deep the tumor has penetrated the stomach lining, whether it has invaded surrounding lymph nodes, and whether it has metastasized. The system most often used to stage stomach cancer in the United States is the American Joint Commission on Cancer (AJCC) TNM system. T indicates how far the tumor has grown within the stomach and into nearby organs, N indicates the degree to which the tumor has spread to lymph nodes, and M indicates the degree to which the tumor has metastasized to distant organs. In TNM staging, information about the tumor, lymph nodes, and metastasis is combined in a process called stage grouping in order to indicate a stage (represented by stages 0, I, IIA, IIB, III, IVA, and IVB). As the stage increases from 0 to IV, the 5-year relative survival rates for patient's diagnosed with stomach cancer at each stage decreases from about 89% (for stage 0) to about 7-8% (for stages IVA and IVB).

Kidney Cancer

The American Cancer Society estimates that there will be about 36,160 new cases of kidney cancer (22,490 in men and 13,670 in women) in the United States in the year 2005, and about 12,660 people (8,020 men and 4,640 women) will die from this disease. Kidney cancer (also referred to as renal cancer or renal cell carcinoma) mostly affects adults between 50 and 70 years of age. If detected early, kidney cancer is curable. However, symptoms may not appear until the tumor has grown to a large size or metastasized to other organs, at which point treatment is difficult.

The 5-year survival rate for individuals diagnosed with kidney cancer is about 90% for those individuals whose tumor is confined to the kidney, about 60% if it has only spread to nearby tissues, and about 9% if it has spread to distant sites (American Cancer Society, *Detailed Guide: Kidney Cancer*. "What Are the Key Statistics for Kidney Cancer (Renal Cell Carcinoma)?").

The majority of kidney cancers are renal cell carcinomas (which accounts for over 90% of malignant kidney tumors), also known as renal adenocarcinomas or clear cell carcinomas. There are five main types of renal cell carcinoma that are identified based on microscopic examination of cell type: clear cell, papillary, chromophobe, collecting duct, and "unclassified." Kidney cancers are also usually graded on a scale of 1 through 4 to indicate how similar the nuclei of the cancer cells are to the nuclei of normal kidney cells (grade 1 renal cell cancers have cell nuclei that differ very little from normal kidney cell nuclei and generally have a good prognosis, whereas grade 4 renal cell cancer nuclei look considerably different from normal kidney cell nuclei and have a worse prognosis). In addition to grade, kidney cancers are also characterized by stage, which describes the size of the cancer and degree of metastasis. The most commonly used staging system is that of the American Joint Committee on Cancer (AJCC) (also referred to as the TNM system), although the Robson classification is an older system that may be occasionally used.

In additional to renal cell carcinomas, other types of kidney cancers include transitional cell carcinomas, Wilms tumors, and renal sarcomas. Wilms tumors are the most common type of kidney cancer in children and are extremely rare in adults. Benign (non-metastasizing) kidney tumors include renal cell adenomas, renal oncocytomas, and angiomyolipomas (American Cancer Society, *Detailed Guide: Kidney Cancer*. "What Is Kidney Cancer (Renal Cell Carcinoma)?").

Risk factors for kidney cancer include the following: age older than 50 years; male (men are twice as likely to get kidney cancer compared to women); cigarette smoking; exposure to asbestos, cadmium, or organic solvents; obesity; a high-fat diet; and von Hippel-Lindau disease (a genetic condition that has a high incidence of kidney cancer).

Symptoms of kidney cancer include hematuria (blood in the urine), abdominal or low back pain, weight loss, fatigue, anemia, fever, high blood pressure, and leg or ankle swelling.

In addition to a detailed medical history, physical examination, and laboratory blood testing, diagnosis of kidney cancer may typically include a computed tomography (CT) scan, ultrasound, magnetic resonance imaging (MRI), intravenous pyelography (a kidney test that utilizes dye and x-rays), or arteriography (a test in which dye is applied to the blood vessels feeding the kidney). To detect metastatic disease, chest X-ray and bone scan may be implemented.

Treatment of kidney cancer in individuals whose tumor is confined to the kidney may involve surgical removal of the kidney (nephrectomy) and surrounding tissue. Radiation therapy may be applied to treat pain and advanced or metastatic kidney cancers or to help shrink a tumor that is causing obstruction. Immunotherapy, such as interferon and interleukin-2, may be used to boost the immune system in patients with advanced kidney cancer (*Journal of the American Medical Association*, JAMA Patient Page: Kidney Cancer).

Liver Cancer

Liver diseases include, for example, liver cancer and liver cirrhosis. Liver cancers include malignant liver tumors such as hepatocellular carcinoma (which is the most common type of liver cancer, accounting for about 75% of primary liver cancers) and cholangiocarcinomas, as well as benign liver tumors such as hemangioma, hepatic adenomas, and focal nodular hyperplasia. Among other risk factors (e.g., cirrhosis, such as from alcohol abuse), chronic infection with hepatitis B or hepatitis C virus is a significant liver cancer risk factor.

Furthermore, when cancer is found in the liver, it is often the case that the cancer did not originate in the liver but rather spread to the liver from another cancer that began in a different part of the body. The liver is a common site of metastases for cancers in other organs (such as cancers of the lung, breast, colon, and rectum), particularly since the liver receives blood from the abdominal organs via the portal vein. Tumor cells may detach from the primary cancer, enter the bloodstream or lymphatic channels, and travel to the liver where the tumor cells begin to grow independently.

Liver cancer is rarely diagnosed at an early stage because it usually does not cause symptoms until the cancer is in its later stages and, because no screening tests exist, small tumors are difficult to detect by physical exams. Liver cancers can sometimes be detected using a blood test for alpha-fetoprotein (AFP). However, some tumors do not produce AFP in quantities significant enough to be detected until the tumor is too large to be removed or has metastasized outside the liver. In addition to blood tests for AFP, other diagnostic techniques that may be used to detect liver cancer include ultrasound, CT scans, MRI, angiography, laparoscopy, and biopsy.

Once diagnosed, liver cancer is typically characterized by a stage using Roman numerals I through IV, with a higher numeral indicating a more serious cancer. Stage III is further sub-divided into A, B, and C.

The three main types of treatment for liver cancer are surgery, radiation therapy, and chemotherapy. Currently, surgery offers the only chance of completely curing liver cancer. However, surgery can only completely cure liver cancer if the cancer is small and can be entirely removed. Unfortunately, complete removal of most liver cancers is not possible. Often the cancer is too large by the time it is detected, is present in many different parts of the liver, or has metastasized beyond the liver. Also, many patients who have cirrhosis do not have enough healthy liver remaining for surgery to even be an option. Radiation therapy may be used to shrink a liver tumor or to provide relief from symptoms such as pain, but it can not cure liver cancer and may not prolong survival for liver patients. With regards to chemotherapy, liver cancer does not respond to most drugs. The most successful single drug has been doxorubicin (Adriamycin), however studies generally have not shown that chemotherapy prolongs survival for liver cancer patients.

Only a small fraction of liver cancers are detected at an early stage and can be successfully removed by surgery. Less than 30% of patients who undergo surgery have their cancer completely removed. The overall 5-year relative survival rate from liver cancer is approximately 7%.

Melanoma (Skin Cancer)

Skin cancer includes, for example, melanoma. Melanoma is a type of cancer in which melanocytes (pigment cells) become cancerous. Melanoma generally originates in the skin (cutaneous melanoma), however melanoma can sometimes originate in other areas of the body where melanocytes are present, such as the eyes, meninges, digestive tract, and lymph nodes. Other types of skin cancer include basal cell and squamous cell cancers. Melanoma is much more likely to metastasize and to be fatal than other types of skin cancer.

Melanoma is increasing in occurrence in the United States and worldwide faster than any other cancer, with an approximately 3% annual increase in new cases. The risk for melanoma in the year 2000 was 1 in 74, and melanoma is the most common cancer in individuals aged 20-30 and the most common cause of cancer death in women age 25-30 (and #2 cause of death, after breast cancer, for women age 30-35). Melanoma accounts for 5% of all skin cancers, but 71% of all skin cancer deaths. However, the earlier that melanoma is diagnosed, the better the prognosis for survival.

Thus, it is clear that early detection of cancer is desirable. Furthermore, it would also be desirable to identify individuals who have an increased risk of developing cancer in the future. Additionally, novel therapeutic agents are needed for treating cancer.

One promising method for early diagnosis of various forms of cancer is the identification of specific biochemical moieties, termed targets, expressed differentially in cancerous cells. The targets may be either cell surface proteins, cytosolic proteins, or secreted proteins. Antibodies or other biomolecules or small molecules that will specifically recognize and bind to the targets in the cancerous cells potentially provide powerful tools for the diagnosis and treatment of the particular malignancy.

GFRa1

GFRa1 is a cystein-rich glycosyl phosphatidylinositol (GPI)-linked ligand binding cell surface receptor. GFRa1 is a member of a family of GFRa receptors that share a common signaling receptor tyrosine kinase subunit c-RET. GFRa1 is the preferred binding partner of glial-cell-line-derived neutrophic factor (GDNF). Following binding with GDNF, GDNF-GFRa1 forms a dimer that can interact with a kinase receptor called c-Ret. Activation of c-Ret triggers transphosphorylation of specific tyrosine residues and activation of intracellular signaling cascades that regulate cell survival, differentiation, proliferation, migration, chemotaxis, branching morphogenesis, neurite outgrowth, and synaptic plasticity. Alternatively, GDNF-GFRa1 dimer can interact with NCAM to initiate signaling. Studies have shown that GDNF-activated N-CAM signaling acts to promote CNS axon growth and Schwann cell migration.

Claudin-4

Claudin-4 is part of a superfamily (24 family members) of tight junction (TJ) related proteins. Claudin-4 is involved in cell-cell adhesion and has an extracellular domain larger than 40 amino acids. Claudins are one of three types of tight-junction cell adhesion proteins (occludin, JAM, claudins) and thought to be the most critical for constituting tight-junction strands. Tight junctions form barriers at epithelial and endothelial cells. Tight junctions regulate cellular movement of water and ions (intracellular sealing) and limit lateral diffusion of lipids and proteins between the apical and basolateral membrane regions to form polarized epithelia. Aggregated TJ proteins form networks of paired TJ strands between each plasma membrane at discrete sites of fusion of plasma membranes of adjacent cells. Each TJ strand associates laterally with another TJ strand in the plasma membrane of an adjacent cell to form a paired TJ strand.

Ion transport is charge- and size-selective with ion transport across tight-junctions. Cation selective transport is mainly by the paracellular pathway, and may be coupled with transcellular transport in certain situations. Activation of Na+-glucose transporters in the intestine is thought to alter structure and function of tight-junctions. With elevated glucose levels, absorption of glucose occurs by transport through tight-junctions when Na+-glucose transporters are saturated.

Macromolecular protein complexes form at tight-junctions. Proteins with a PDZ domain bind to the cytoplasmic surface of tight-junctions by direct interaction with the carboxyl terminus of claudins. This functions to cross-link TJ strands to actin cytoskeleton, and plays a role in regulating paracellular transport across tight-junctions. These proteins also function as adaptor proteins to recruit signaling molecules for activation of downstream signal transduction pathways, and play a role in cell-matrix adhesion with formation of a complex at integrin-based adhesion sites. For a further review, see Tsukita et al., "Multifunctional strands in tight junctions", *Nat Rev Mol Cell Biol.* 2001 April; 2(4):285-93.

Altered permeability of tight junctions associated with multiple pathological states, including inflammation (e.g., inflammatory bowel disease) and tumorigenesis. Claudin-4 functions as a receptor for *Clostridium perfringens* enterotoxin (CPE), which is known to injure intestinal epithelial cells and breast cancer cells by increasing membrane permeability, thereby resulting in loss of osmotic equilibrium leading to cell death (Katahira et al. *JCB* 1999; Kominsky et al. *Am J Pathol* 2004). Cytotoxic effects of CPE appears to be restricted to Claudin-4 expressing cells (demonstrated in pancreatic cancer), and has been proposed as a novel treatment for Claudin-4 expressing solid tumors (Leder et al. *Gastroenterology* 2001).

Altered regulation of claudin-4 occurs in multiple cancers. For example, EGF signaling through the Ras signaling pathway increases protein synthesis of several claudins, including Claudin-4 (Singh et al. *JBC* 2004). Claudins have been shown to activate pro-matrix metalloproteinase-2 through direct interactions, and Claudin-4 recruits membrane-type matrix metalloproteinases on cell surfaces to high focal concentrations of enzymes for activation of MMP-2 (Miyamori et al. JBC 2001).

Claudin-4 is involved in cancer biology. For example, increased claudin-4 expression occurs in multiple tumor types [e.g., pancreatic cancer (Leder et al. *Gastroenterology* 2001), prostate cancer (Long et al. *Cancer Res* 2001), ovarian carcinoma (Santin et al. *Int J Cancer* 2004; Hibbs et al. *Am J Pathol* 2004), and squamous cell carcinoma (keratinized tumors) (Morita et al. *Br J Dermatol* 2004)]. Overexpression of Claudin-4 in pancreatic cancer correlates with decreased invasiveness in vitro (Boyden chamber) and in vivo (mouse lung colonization assay) (Michl et al. *Cancer Res* 2003). Reduced expression of claudin-4 and E-cadherin correlates with poor differentiation in gastric cancer (Lee et al. *Oncol Rep* 2005). Claudin-4 and claudin-3 are expressed in greater than 90% of breast carcinomas, but no correlation has been found with estrogen or progesterone receptor status or with tumor grade (Soini et al. *Hum Pathol* 2004).

Thus, Claudin-4 is involved in cell-cell adhesion, overexpression of Claudin-4 is documented in the literature in several cancers, Claudin-4 is overexpressed in greater than 90% of breast carcinomas, and Claudin-4 is potentially involved in regulating metastasis and the invasive potential of cancer cells.

ASCT2

ASCT2, also known as Neutral Amino Acid Transporter (NAAT), is a cell surface transporter involved in cellular metabolism. ASCT2 has an extracellular domain that is larger than 100 amino acids in size. Antagonism of ASCT2 function stimulates apoptosis.

ASCT2, which is a member of the ASC amino acid transporter system, is a Na+ dependent transporter with high affinity for glutamine. ASCT2 also transports other zwitterionic amino acids such as serine, threonine, cysteine, alanine, and asparagine. Glutamine is an essential metabolic intermediate required for cellular growth. Glutamine requirements are increased in rapidly dividing tumor cells (MA Medina. 2001. *J Nutr* 131(9 Suppl):2539S-2542S).

Hepatoma-specific expression of ASCT2 is reported in the literature. ASCT2 is not expressed in normal liver tissue. In hepatocellular carcinoma, glutamine uptake is 10-30 times faster than in normal hepatocytes. Antisense knockdown of ASCT2 expression resulted in induction of apoptosis in hepatoma cells (BC Fuchs, et al. 2004. *Am J Physiol Gastrointest Liver Physiol* 286:G467-G478).

Expression of ASCT2 in colorectal adenocarcinoma is reported in the literature. ASCT2 protein was detected by western blot using MYZ polyclonal antibodies in colon tumor lysates. Immunohistochemistry (IHC) was performed on 63 colon tumor samples, with the following results: negative 41%, 1-25% of cell positive 24%, 26-50% of cells positive 13%, and greater than 50% of cells positive 22%. ASCT2 expression was associated with decreased patient survival (p=0.0002) (D Witte, et al. 2002. *Anticancer Res* 22:2555-2558).

Expression of ASCT2 in prostate is reported in the literature. IHC was performed using MYZ polyclonal antibodies on 640 prostate samples [normal, benign prostatic hyperplasia (BPH), and adenocarcinoma]. High level of ASCT2 expression was found in 49% normal, 25.8% BPH, and 25.3% adenocarcinoma. Significant decrease in ASCT2 expression in BPH and adenocarcinoma compared to normal prostate was observed. Higher ASCT2 expression was associated with poor prognostic factors, aggressive behavior, and poor survival (R Li, et al. 2003. *Anticancer Res* 23:3413-3418).

CD166 (ALCAM)

ALCAM (interchangeably referred to as CD166) is a member of the immunoglobulin superfamily IgSF. ALCAM is expressed in a subset of activated leukocytes, monocytes, fibroblasts, epithelial, and neural cells. The extracellular region of ICAM (typically about 527 amino acids in size) consists of five Ig-like domains. The two N-terminal domains closely resemble variable-type (V-) domains while the three following domains are more similar to the constant (C-) domains. ICAM has a short intracellular domain that is typically about 32 amino acids in size.

ALCAM is involved in both homophilic adhesion and heterophilic adhesion to CD6, which is a member of the scavenger receptor cysteine-rich superfamily. ALCAM may also bind NgCAM and HDL. CD6 is a member of the scavenger receptor cysteine-rich superfamily. CD6 is expressed on thymocytes, mature T-cells, and some B cells. Adherence of CD6+ thymocytes to ALCAM-expressing thymic epithelial cells is important for the differentiation and development of mature T cells. Interaction of CD6+ mature T cells and CD166-expressing monocytic antigen presenting cells is important for T cell activation. T cell activation can be inhibited by addition of monomeric, soluble forms of CD6 or CD166.

ALCAM homophilic interactions are important in the homing of hematopotietic stem cells on to stromal cells, thereby playing an important role in the regulation of hematopoietic development. Clustering of ALCAM at the cell surface is regulated by the actin cytoskeleton and the stabilization of this clustering may involve PKCa.

ALCAM contains a diSia epitope. diSia epitopes play an important role in neurite extension. Inhibition of this epitope using mAbs can specifically inhibit neurite formation.

CD166−/− mice are viable, fertile, and display no gross external morphological defects, however axon fasciculation defects and retinal dysplasias are observed. No obvious defects in circulating lympohocytes are observed, but preliminary analysis reveals histological abnormalities of the spleen (*Mol Cell Neurosci* (2004) 59-69).

It has been demonstrated that ALCAM derived from an A375 melanoma line contains GlcNAc beta 1-6 branched oligosaccharides, which is a sugar moiety associated with metastatic potential (*Melanoma Res* (2004) 14 479-485).

scFV, mAb, and CD6-Fc all induce ALCAM internalization into an ovarian carcimoma line. scFv-saporin immunotoxin selectively kills cell lines expressing ALCAM (*J Cell Sci* (2005) March 15).

Regarding the role of CD166 (ALCAM) in tumor biology, CD166 is a marker of tumor progression in primary malignant melanoma (MM). 4/38+ve (benign) −17/23+ve late stage (MM) −13/28 metastasis (*Am J Path* (2000) 15 769-774). CD166 is overexpressed in colorectal carcinoma and correlates with shortened patient survival (*J Clin Path* (2004) 57: 1160-1164). Expression of CD166 is associated with poor prognosis in bladder cancer (*UroOncology* (2003) 3 121-129). CD166 is upregulated in low-grade prostate cancer and progressively lost in high-grade lesions (*The Prostate* (2003) 54 34-43). In two breast cancer studies, CD166 expression appeared elevated in early stage tumors (PR+/ER+) (*Breast Cancer Res* (2004) δ 478-487). Anti-ALCAM antibody decreased proliferation in breast cancer cells and reduced adhesion (*FASEB J* (2004) 18 A330).

For a further review of ALCAM, see also *J. Biol. Chem.* (2004) 279 55315-55323.

CD55

CD55 is a membrane-associated complement regulatory protein and has an extracellular domain that is typically larger than 300-400 contiguous amino acids. CD55 is involved in immune modulation and functions to protect cells from bystander attack by blocking the complement cascade.

CD55 recognizes C4b and C3b fragments which are locally generated during C4 and C3 activation. Interaction of DAF with cell-associated C4b and C3b polypeptides interferes with their ability to catalyze the conversion of C2 and factor B to enzymatically-active C2a and Bb and thereby prevents the formation of C4b2a and C3bBb, which are the amplification convertases of the complement cascade.

CD55 is expressed on all serum-exposed cells (red blood cells, leukocytes, endothelial cells and epithelial cells), and the soluble form is present in body fluids and extracellular matrix (serum level ~30 ng/ml) (C. Makidono et al., 2004. *J Lab Clin Med* 143:152-158).

CD55 is a possible ligand for CD97 (upregulated on most leukocytes during activation), which may serve as an adhesion mechanism (J. Hamann et al., 1996. *J Exp Med* 184: 1185-1189).

Complement regulatory proteins are commonly deregulated in tumor cells. Through over-expression of CD55, CD46, CD35 and/or CD59, tumor cells are able to protect themselves for complement-mediated lysis, which is a major limitation to immunotherapeutic treatments.

CD55 is associated with poor prognostic indicator in colorectal carcinoma. High CD55 levels are associated with a 24% survival rate, and low CD55 levels are associated with a 50% survival rate (L. G. Durrant, et al., 2003. *Cancer Immunol Immunother* 52(10):638-42).

CD55 is upregulated in gastric carcinomas (T. Kiso et al., 2002. *Histopathology* 40:339-347). Also, loss of CD55 is associated with aggressive breast tumors (Z. Madjd, et al. 2004. *Clin Cancer Res* 10(8):2797-803).

CD55 is cleaved from a GPI anchor in colorectal carcinomas and can be detected in stool samples, and is therefore possibly useful as a diagnostic (M. Kawada et al. 2003. *J Lab Clin Med* 142:306-312).

Human IgM antibody (SC-1) against a tumor-specific form of CD55 has been isolated from a gastric carcinoma patient. The antigenic site of SC-1 is an N-linked carbohydrate residue. SC-1 induces specific apoptosis of gastric carcinoma cells both in vitro and in vivo (F. Hensel et al., 1999. *Cancer Res* 59:5299-5306). SC-1 was successfully used in a phase I/II clinical study, showing induction of regression and apoptosis in primary gastric carcinomas with minimal toxicity (H. P. Vollmers et al., 2004. *J Clin Oncol* 22:4070 (Abstract)).

Antibody that was raised against an osteosarcoma cell line was used for clinical imaging of over 300 patients with colorectal, gynecologic, and gastrointestinal lesions in the 1980s. The antibody detected lesions as small as 1 $cm^3$ in 70% of patients. The antigen for this antibody is CD55.

Anti-CD55 mAb significantly enhanced activity of Rituxan (Biogen IDEC, anti-CD20 for NHL) when used together in a cell-based study (Viragen).

Human anti-idiotypic antibody that mimics CD55 has been used successfully in over 200 colorectal and osteosarcoma patients (D. T. J. Buckley et al., 1995. *Hum. Antibody Hybridoma* 6:68-72).

Transglutaminase 2 (TG2)

Transglutaminase 2 (TG2) is a member of the transglutaminase family of enzymes that catalyses $Ca^{2+}$ dependent reactions, resulting in the modification of glutamine and lysine residues. TG2 contains a large extracellular domain that is typically greater than 200 amino acids in size.

At membrane locations, TG2 can act as a G-protein to mediate transmembrane signaling. Gh/TG2 couples $a_{1b}$ and $a_{1d}$ adrenoreceptors, thromboxane and oxytocin receptors to phospholipase C, mediating inositol phosphate production in response to agonist activation. TG2 can also act as an isopeptidase in a $Ca^{2+}$-dependent manner. Thus, TG2 is able to modify major components of the cytoskeleton. TG2 is externalized from cells where it mediates the interaction of integrins with fibronectin and cross-links proteins of ECM. This function has implications in adhesion and spreading. Under certain conditions, TG2 translocates to the nucleus and functions as a G-protein or as a transamidase that cross-links histones. Thus, TG2 may have a role in chromatin modification or gene expression regulation.

CD49f

CD49f (integrin α6) is a cell surface receptor with an extracellular domain that is typically larger than 1000 amino acids in size. This protein functions as a receptor for laminin. The α6 chain is found in only two heterodimeric combinations, α6β1 and α6β4. The α6β1 integrin (VLA-6) binds laminins-1, -2 and -4, while α6β4 binds laminin-1 and, with higher affinity, laminin-5 (*Eur. J. Biochem,* 1991; 199:425). The α6β4 integrin is found mainly in hemidesmosomes, and the large cytoplasmic domain of the β4 integrin is important in the integrity of these structures (*EMBO J,* 1990; 9:765). Mice lacking either α6 or β4 genes display perinatal lethality (*Genes Dev,* 1995; 9:1883).

CD49f contributes to breast carcinoma survival and progression (*Mol Cells,* 2004; 17:203) and is over-expressed in human esophageal carcinomas (*Int J. Oncol,* 2000; 16:725) and human pancreatic carcinoma (*Cancer Lett,* 1997; 118:7). CD49f is also expressed in human pulmonary squamous cell and adenocarcinomas (Hum Pathol, 1998; 29: 1208). In hepatocellular carcinoma, CD49f exhibits differential display and messenger RNA overexpression (*Hepatology,* 1995; 22: 1447). CD49f is associated with a migratory and invasive phenotype in human prostate carcinoma cells (*Clin Exp Metastasis,* 1995; 13: 481).

CD98

CD98 (4F2hc) (SLC3A2; solute carrier family 3 member 2 isoform A) belongs to a family of glycoprotein-associated amino acid transporters. CD98 has an extracellular domain that is typically greater than 400 amino acids in size and functions as a sodium-independent transporter for cellular uptake of large neutral amino acids. CD98 has been implicated in hematopoietic and osteoblast cell differentiation.

CD98 has been shown to be associated with CD147, ASCT2, and β1 integrin (CD29), which is involved in CD98-induced cell aggregation. Through association with integrin, CD98 plays a role in cell adhesion, modulating the signaling for tumor cell proliferation and anchorage independent growth. The association of CD98 with integrin α4β1 is involved in T-cell activation.

In its interaction with CD98, CD147 may act as an ancillary adhesion molecule mediating cell-cell binding. CD147 may inhibit CD98 signaling for homotypic aggregation by blocking CD98-induced tyrosine phosphorylation. Additionally, a CD98-CD147 complex may mediate cell proliferation as indicated by RNA interference (RNAi) knockdown In several cancers such as salivary adenoid cystic carcinoma, oral squamous cell carcinoma, squamous cell carcinoma of the larynx and gliomas, CD98 is overexpressed. Sequiterpene lactone cynaropicrin inhibits activation of β1 integrin and CD98 aggregation by downregulating expression of β1 integrin and CD147 and blocking downstream the ERK signaling cascade and rearrangements of the cytoskeleton. The compound has anti-inflammatory and immunomodulatory effects and is cytotoxic and pro-apoptotic in cancer cells.

CD104 (β4 Integrin)

β4 integrin (CD104) is a Type I membrane protein comprising an extracellular domain typically greater than 500 amino acids and a large cytoplasmic domain typically greater than 1000 amino acids that contains 4 fibronectin type III domains. Five alternate splice forms of β4 integrin (β4A-β4E) have been identified. β4 integrin associates with integrin α6 to form the heterodimer integrin α6/β4, which is a receptor for laminin-5. α6/β4 uses laminin 5 anchoring filaments to attach an epithelium to the basal lamina to form hemidesmosomes. [*J Cell Bio* (1991) 113: 907-917]

Ligation of α6/β4 causes phosphorylation of the cytoplasmic tail of β4 through activation of an integrin-associated Src family kinase, causing recruitment of Shc and activation of Ras and PI-3K. The phosphorylation of β4 causes disruption of hemidesmosomes [*J Biol Chem* (2001) 276: 1494-1502*]*, *[Cancer Cell* (2004) δ: 471-483]. The N-terminus of the β4 cytoplasmic domain (up to amino acid residue 1355) is involved in adhesion. The C-terminal portion of the β4 tail contains 5 tyrosine phosphorylation sites, including those needed for recruitment of Shc and PI-3K. Targeted deletion of the C-terminal portion of the β4 tail inhibited signaling through ERK and AKT, but not adhesion to laminin 5 and assembly of hemidesmosomes.

β4 integrin promotes endothelial cell migration and invasion, with the β4 substrate domain inducing the nuclear accumulation of ERK and NF-κB during endothelial cell migration (in vitro) and angiogenesis (in vivo). The β4 substrate domain has been identified as promoting tumor invasion and angiogenesis [*Cancer Cell* (2004) δ: 471-483].

Signaling by α6/β4 has been shown to promote bFGF and VEGF induced angiogenesis [*Cancer Cell* (2004) 6: 471-483]. Signaling by α6/β4 also promotes adhesion of keratinocytes through phosphorylation of PKB/Akt [*J Invest Dermatol* 123:444-451].

β4 integrin knockout mice exhibit a lack of hemidesmosomes and have severe junctional epidermolysis bullosa (epidermal blistering). β4 null mice were unable to survive more than a few hours after birth [*J Cell Bio* (1996) 134: 559-572]. In autosomal dominant polycystic kidney disease, kidney cysts demonstrate an overexpression of β4 integrin [*Am J Pathol* (2003) 163: 1791-1800].

By mediating tumor cell adhesion to endothelial CLCA2 (associated with colonization of the lung by breast cancer cells), β4 integrin is involved in the metastasis of breast cancer to the lung [*J Biol Chem* (2001) 276: 25438-35446]; [*J Biol Chem* (2003) 278: 49406-49416]. β4 integrin ligation to mCLCA1 (homolog to hCLCA2) activates focal adhesion kinase and mediates early metastatic growth of B16-F10 melanoma cells in the lung [*J Biol Chem* (2002) 277: 34391-34400]. β4 integrin also causes selective apoptosis in endothelial cells bound to tumor cells through activation of chloride channels. Endothelial cells incubated with β4 integrin undergo apoptosis [*J Biol Chem* (2001) 276: 25438-35446].

DPEP1

Dipeptidase 1 (DPEP1) (Swiss Prot Accession Number: P16444) is a GPI-anchored cell surface glycoprotein (homodimer) (*J. Mol. Bio.* (2002) 321: 177-184). DPEP1 has an extracellular domain that is typically about 369 amino acids in size.

DPEP1 is a zinc-containing enzyme that hyrdolyzes various dipeptides, antibiotics (b-lactams), and leukotrienes. DPEP1 is implicated in renal metabolism of glutathione and it conjugates. DPEP1 is expressed in the brush-border region of the proximal tubules of the renal cortex (*Biochem. J.* (1989) 257: 361-367). Cilastatin, an inhibitor of DPEP1, is commonly delivered with Imipenem, a b-lactam antibiotic, to inhibit breakdown in the kidney (*J. Antimicrob. Chemother*. (1983) 12: 1-35).

DPEP1 was determined to be >20-fold over-expressed in colon adenomas and carcinomas by SAGE analysis and localized to the epithelium of colorectal tumors by ISH (*Cancer Research* (2001) 61: 6996-7001). DPEP1 showed 2-fold or greater over-expression by relative RT-PCR in colon tumors compared to normal colon in 82% of patients tested, and over-expression observed in all stages of disease. DPEP1 was detected by RT-PCR in disseminated tumor cells purified from the blood and intra-operative lavage samples of colorectal cancer patients (*Cancer Letters* (2004) 209: 67-74).

Tissue Factor (TF)

Tissue factor (TF) is a cell surface glycoprotein with a large extracellular domain (typically greater than 200 amino acids in size). TF is the primary cellular initiator of blood coagulation where it serves as the cellular receptor for Factor VII. Signaling events linked to TF-Factor VIIa interaction can lead to tumor cell proliferation, transcriptional changes, altered cell-shape, and migration/adhesion.

TF is typically not expressed in cells that are in direct contact with the blood. TF is expressed in extravascular tissue, in fibroblasts and smooth muscle cells, where it serves as a haemostatic envelope outside the vasculature, poised to activate coagulation upon vascular injury. In vascular endothelial cells and monocytes, TF is typically absent, but TF is rapidly induced in response to inflammatory stimuli such as bacterial liposaccharide and inflammatory cytokines. Increased intravascular levels of TF have been reported in diverse pro-thrombotic syndromes such as myocardial infarction and sepsis.

Patients with malignant diseases are predisposed to hypercoagulation. Trousseau first reported the increased frequency of thrombosis in patients with gastrointestinal cancers in 1865, and subsequently this hypercoagulable state has been associated with TF. Correlation between elevated expression of TF and both advanced stages of malignancy and/or poorly differentiated tumors has been reported in several cancers including pancreatic, breast, colorectal, NSCLC, prostate, and glioma. Elevated expression of TF in tumors has also been correlated with other non-favorable prognostic indicators such as increased angiogenesis and multi-drug resistance. An alternatively spliced secreted form of TF has been detected in plasma that has elevated expression levels in normal samples (~50 pg/mL) compared with tumors (50-350 pg/mL) in the plasma of breast cancer patients. For further information regarding TF, see Bogdanov et al., "Alternatively spliced human tissue factor: a circulating, soluble, thrombogenic protein", *Nat. Med.* (2003) 9: 458-462.

Transfection of TF promoted metastasis in a melanoma mouse model, indicating a role for the cytoplasmic domain (*Proc Natl Acad Sci USA* (1995) 92:8205-9). Introduction of TF into a pancreatic adenocarcinoma cell line lead to both increased tumor cell invasion in vitro and primary tumor growth in vivo (*Br J Surg*. (1999) 86:890-4). TF knockdown by RNAi suppressed invasiveness of a pancreatic cell line (BxPC3) in vitro (*Clin Cancer Res* (2005)11:2531-2539). Humanized mAb (CNTO 859, 860) reduced metastasis (MDA-MB-231) to the lung from tail-injected 1000×, and also reduced tumor growth in a SubQ model (Centocor) (*Journal of Immunotherapy*. (2004) 27(6):S10). Anti-TF mAb (H36) abolished prostate (DU145) and reduced breast (MDA-MB-435) metastasis to the lung (Sunol/Dow) (*Journal Thrombosis and Haemostasis* (2003) 1 Supplement 1 July: #OC308).

NA/K ATPase Beta3

NA/K ATPase beta3 is a transporter involved in cellular metabolism and regulates a variety of transport functions in epithelial cells. NA/K ATPase beta3 has an extracellular region that is typically larger than 200 amino acids in size.

Blocking NA/K ATPase beta3 has been reported to sensitize tumor cells to pro-apoptotic stimuli.

Vasoactive Intestinal Polypeptide Receptor 1 (VIPR1)

Vasoactive intestinal polypeptide receptor 1 (VIPR1) belongs to the G-protein coupled receptor 2 family and has an extracellular domain that is typically greater than 100 amino acids in size. VIPR1 is involved in pulmonary and gastrointestinal vascular smooth-muscle relaxation, and VIPR1 ligand (VIP) analogs are in clinical development as bronchodilators for respiratory diseases such as COPD and asthma.

CD26

CD26 (dipeptidylpeptidase 4, DPP4, or adenosine deaminase complexing protein 2) is a type II cell surface serine exopeptidase that has an extracellular domain that is typically greater than 700 amino acids in size and which also exists in soluble form. CD26 is implicated in various biological processes including cell-matrix interactions, T-cell activation, inflammation, and regulating insulin secretion. Inhibitors of CD26 are in clinical development for type 2 diabetes.

CXADR

CXADR (coxsackie virus and adenovirus receptor; Swiss-Prot Accession Number: P78310) is a type I membrane receptor and a member of the immunoglobulin superfamily (*Science* (1997) 275; 1320-1323). CXADR has an extracellular domain that is typically larger than 200 amino acids in size. CXADR is a component of the epithelial apical junction complex that is essential for the tight junction integrity (*J Biol Chem* (1999) 274; 10219-10226). CXADR recruits intracellular PDZ domain-containing protein LNX (Ligand-of-Numb Protein-X) to intercellular contact sites (*J Biological Sci* (2003) 278; 7439-7444). CXADR may function as a homophilic cell adhesion molecule (*Molecular Brain Research* (2000) 77; 19-28). CXADR is involved in transepithelial migration of PMN through adhesive interactions with JAML located in the plasma membrane of PMN (*Mol Biol Cell* (2005) 16; 2694-703). CXADR functions as a receptor for group B coxsackieviruses and subgroup C of adenoviruses (AD2 and AD5); susceptibility to infection has been correlated with membrane expression level (*Proc. Natl. Acad. Sci* (1997) 94; 3352-56). CXADR knockout mice exhibited embryonic lethal phenotype associated with cardiac defects (*Genesis* (2005) 42; 77-85).

Over expression of CXADR has been observed in osteosarcomas and malignant thyroid tumors (*Cancer Sci* (2003) 94; 70-75; *Thyroid* (2005) 15; 977-87). CXADR is involved in mediating tumor formation in lung cancer cells; a CXADR antisense plasmid vector abrogated xenografts mediated by high expressing lung cancer cells and inhibited soft agar colony formation (*Cancer Res* (2004) 64; 6377-80). CXADR expression is enhanced after transition from preneoplastic precursor lesions to neoplastic mammary cancer outgrowth in a syngenic mouse tumor model (*Clin Cancer Res* (2005) 11; 4316-20). In a 3D tissue culture model of breast cancer cells, disruption of polarity and integrity, as in malignant transformation, can lead to up-regulation of CXADR (*Proc. Natl. Acad. Sci* (2003) 100, 1943-1948). CXADR overexpression in ovarian and cervical cancer cell lines enhanced cell survival by protecting against apoptosis (*Clin Cancer Res* (2005) 11; 4316-20). Expression of CXADR in gastrointestinal cancers correlated with tumor differentiation (*Cancer Gene Ther* (2006) Epub). Loss of CXADR expression associated with advanced bladder cancer (*Urology* (2005) 66; 441-6). Overexpression of CXADR in an ovarian cancer cell line inhibited cell migration (*Exp Cell Res* (2004) 298; 624-31). Expression of CXADR decreased in primary prostate cancer but is highly expressed upon metastasis (*Cancer Res* (2002) 62; 3812-8).

PTK7

Protein tyrosine kinase 7 (PTK7) is a transmembrane glycoprotein containing RTK consensus sequences that may function in kinase signaling, cell adhesion and signal transduction, and planar cell polarity (PCP) pathways. PTK7 has an extracelluar domain that is larger than 600 amino acids in size.

Macrophage-Stimulating Protein Receptor Precursor (MISTR)

Macrophage-stimulating protein receptor precursor (MISTR), also known as MST1R, MSP receptor, p185-Ron, CDW136, and CD136 antigen, is a receptor tyrosine kinase that has an extracellular domain that is typically larger than 800 amino acids in size.

SUMMARY OF THE INVENTION

A diseased, e.g. malignant, cell often differs from a normal cell by a differential expression of one or more proteins. These differentially expressed proteins, and suitable fragments thereof, are useful as markers for the diagnosis and treatment of the disease. The present invention provides the following targets and methods of using these targets: GFRa1, Claudin-4, ASCT2, CD166-ALCAM, CD55, TG2, CD49f, CD98, CD104, DPEP1, Tissue Factor (TF), Na-K ATPase beta3, VIPR1, CD26, CXADR, PTK7, and MISTR (see Figures), which are collectively referred to herein as "CAT" (cancer-associated targets). Each of these targets is associated with specific types of cancers in particular, as shown in the Figures and described in section 14 of the Examples section ("Summary of experimental validation").

Based on the finding that CAT are differentially expressed in disease cells, particularly in cancer, in comparison to normal cells, the present invention provides methods and compositions for diagnosing and treating diseases, particularly cancer, using CAT as a target.

In the context of the present invention, the differentially expressed CAT proteins (SEQ ID NOS:1-4, 9, 11-12, 16-19, 24-36, 51-59, 69-74, 81-85, 91-102, 115-116, 119-121, 127-134, 144-145, 148-149, 152-159, 168-174, and 182-183) and suitable fragments thereof, and nucleic acids encoding said proteins (SEQ ID NOS:5-8, 10, 13-15, 20-23, 37-50, 60-68, 75-80, 86-90, 103-114, 117-118, 122-126, 135-143, 146-147, 150-151, 160-167, 175-181, 184-185) and suitable fragments thereof, are referred to herein as CAT proteins, CAT peptides, or CAT nucleic acids, and collectively as CAT.

The CAT proteins of the present invention may serve as a target for one or more classes of therapeutic agents, including antibody therapeutics. CAT proteins of the present invention are useful in providing a target for diagnosing a disease, or predisposition to a disease mediated by the peptide, particularly cancer. Accordingly, the invention provides methods for detecting the presence, or levels of, a CAT protein of the present invention in a biological sample such as tissues, cells and biological fluids isolated from a subject.

The diagnosis method may detect CAT nucleic acids, proteins, peptides, and fragments thereof, that are differentially expressed in diseases in a test sample, preferably in a biological sample.

The further embodiment includes but is not limited to, monitoring the disease prognosis (recurrence), diagnosing disease stage, preventing the disease and treating the disease.

Accordingly, the present invention provides a method for diagnosing or detecting a disease (particularly cancer) in a subject comprising: determining the level of CAT in a test sample from said subject, wherein a differential level of said CAT in said sample relative to the level in a control sample from a healthy subject, or the level established for a healthy subject, is indicative of the disease. The test sample includes but is not limited to a biological sample such as tissue, blood, serum or biological fluid.

The diagnostic method of the present invention may be suitable for monitoring the disease progression or the treatment progress.

The diagnostic method of the present invention may be suitable for other epithelial-cell related cancers, such as lung, colon, prostate, ovarian, breast, bladder renal, hepatocellular, pharyngeal, and gastric cancers. The present invention further provides antagonists to CAT proteins or peptides and pharmaceutical compositions that comprise the antagonist and a suitable carrier. The antagonist may be used for treating the disease. Preferably, the antagonist is an antibody that specifically binds to a CAT protein or peptide. In another preferred embodiment, the antagonist may be a small molecule that inhibits the function or levels of CAT, or an inhibitory nucleic acid molecule, such as an RNAi or antisense molecule against a CAT nucleic acid.

The present invention provides additionally a pharmaceutical composition comprising an antagonist to a CAT of the present invention, and a pharmaceutically acceptable excipient, for treating a disease, particularly cancer.

The present invention further provides a method for treating a disease, particularly cancer, comprising administering to a patient in need of said treatment a therapeutically effective amount of the pharmaceutical composition.

The present invention further provides a method for screening for agents that modulate CAT protein activity, comprising the steps of (i) contacting a candidate agent with a CAT protein, and (ii) assaying for CAT protein activity, wherein a change in said activity in the presence of said agent relative to CAT protein activity in the absence of said agent indicates said agent modulates said CAT protein activity. Candidate agents include but are not limited to protein, peptide, antibody, nucleic acid such as antisense RNA, RNAi fragments, small molecules. RNAi is particularly effective at suppressing gene expression, and is therefore useful for blocking or limiting production of a CAT protein, such as for treating cancer or other diseases.

The screening method may also determine a candidate agent's ability to modulate the expression level of a CAT protein or nucleic acid. The method comprises (i) contacting a candidate agent with a system that is capable of expressing a CAT protein or CAT mRNA, (ii) assaying for the level of a CAT protein or CAT mRNA, wherein a specific change in said level in the presence of said agent relative to a level in the absence of said agent indicates said agent modulates said CAT level.

The present invention further provides a method to screen for agents that bind to a CAT protein, comprising the steps of (i) contacting a test agent with a CAT protein and (ii) measuring the level of binding of agent to said CAT protein.

DESCRIPTION OF THE SEQUENCE LISTING

The Sequence Listing discloses exemplary protein and nucleic acid sequences for each CAT (Cancer-Associated Target). Specifically, the Sequence Listing discloses amino acid sequences of CAT proteins and nucleic acid sequences of CAT transcripts that encode these CAT proteins, as set forth in the following table:

| Cancer-Associated Target | Protein SEQ ID NO | Transcript SEQ ID NO |
|---|---|---|
| GFRa1 | 1-4 | 5-8 |
| Claudin-4 | 9 | 10 |
| ASCT2 | 11-12 | 13-15 |
| CD166-ALCAM | 16-19 | 20-23 |
| CD55 | 24-36 | 37-50 |
| TG2 | 51-59 | 60-68 |
| CD49f | 69-74 | 75-80 |
| CD98 | 81-85 | 86-90 |
| CD104 | 91-102 | 103-114 |
| DPEP1 | 115-116 | 117-118 |
| Tissue Factor (TF) | 119-121 | 122-126 |
| Na-K ATPase beta3 | 127-134 | 135-143 |
| VIPR1 | 144-145 | 146-147 |
| CD26 | 148-149 | 150-151 |
| CXADR | 152-159 | 160-167 |
| PTK7 | 168-174 | 175-181 |
| MISTR | 182-183 | 184-185 |

The Sequence Listing is hereby incorporated by reference pursuant to 37 CFR 1.77(b)(11).

DESCRIPTION OF THE FIGURES

GFRa1

FIG. 1. GFRa1 is Over-Expressed in Breast and Renal Cancer.

FIG. 2. Prevalence of GFRa1.

FIG. 3. IHC Analysis Reveals GFRa1 staining on Breast Cancer samples does not correlate with ER, PR or HER2 Status.

Figure 4:
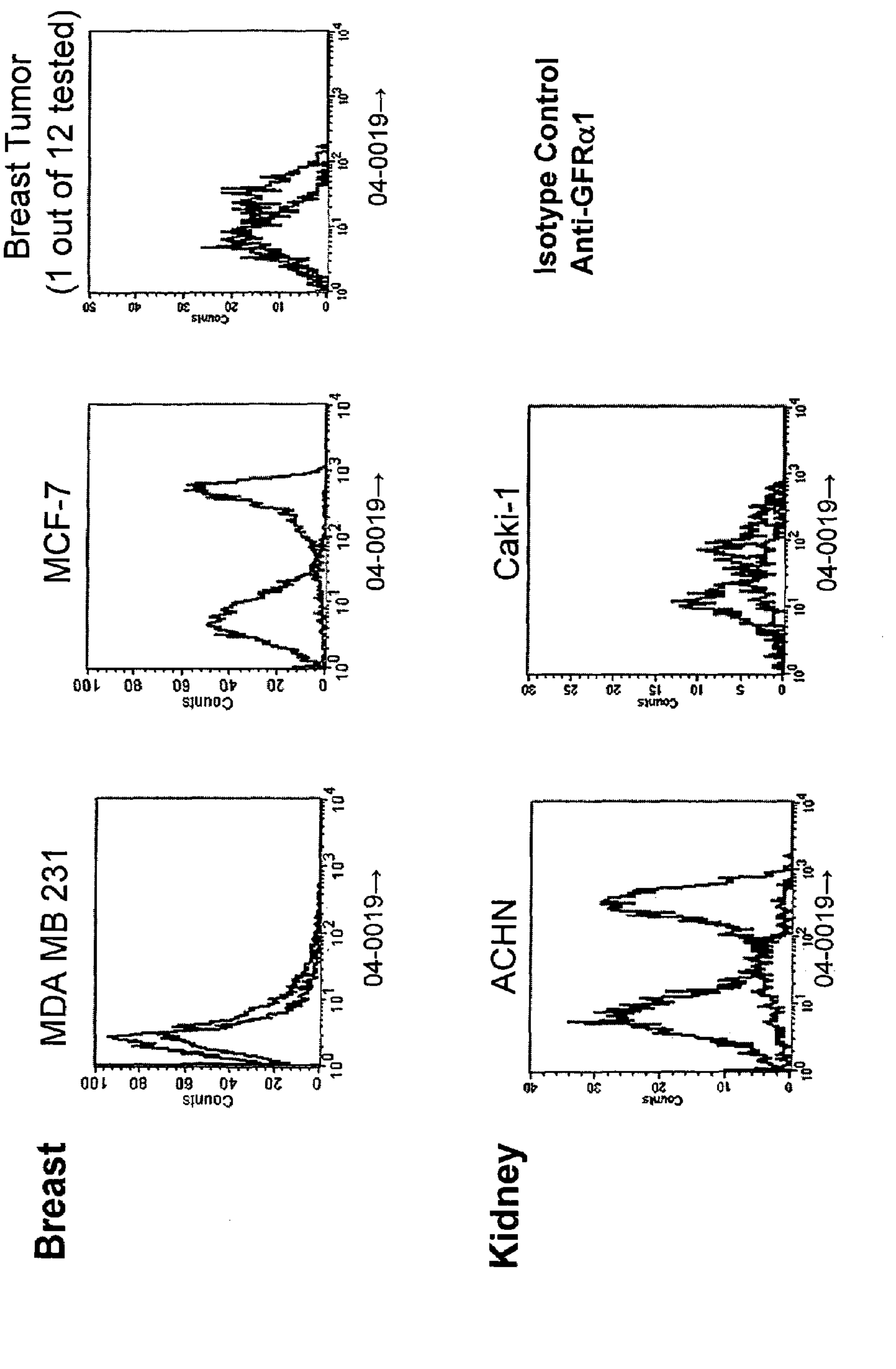

FIG. 4. GFRa1 Expression in Breast and Kidney Cell Lines and Tumors.

Figure 5:
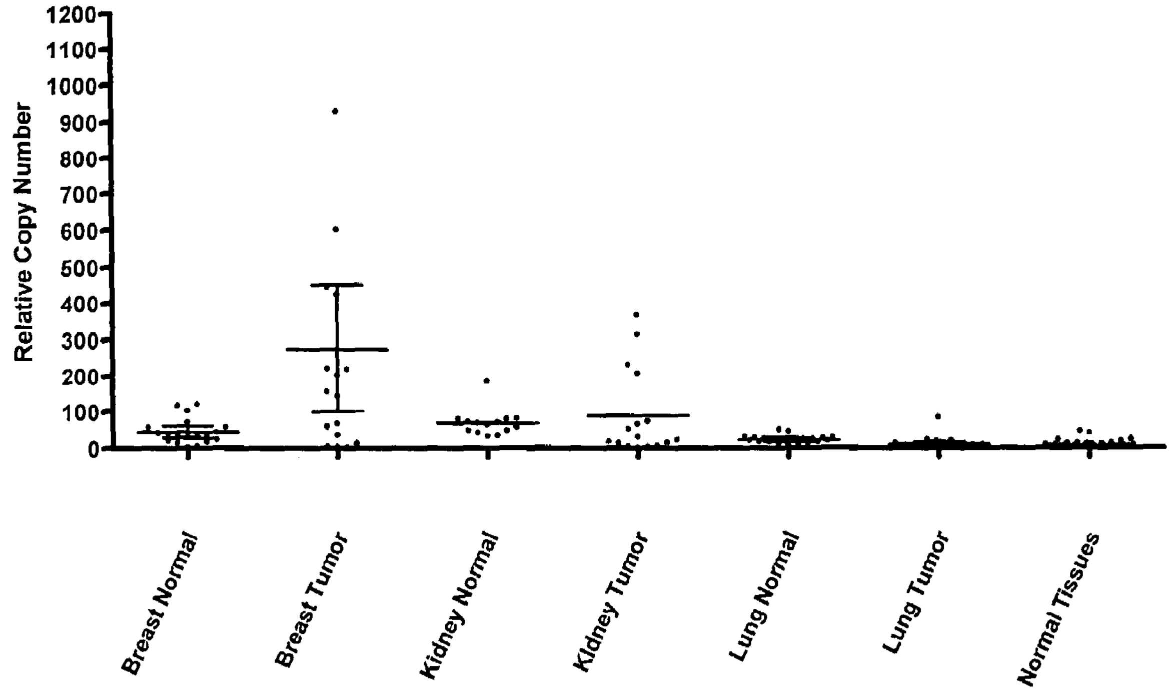

FIG. 5. GFRa1 mRNA Expression Analysis in Multiple Tumor Tissues.

Figure 6:
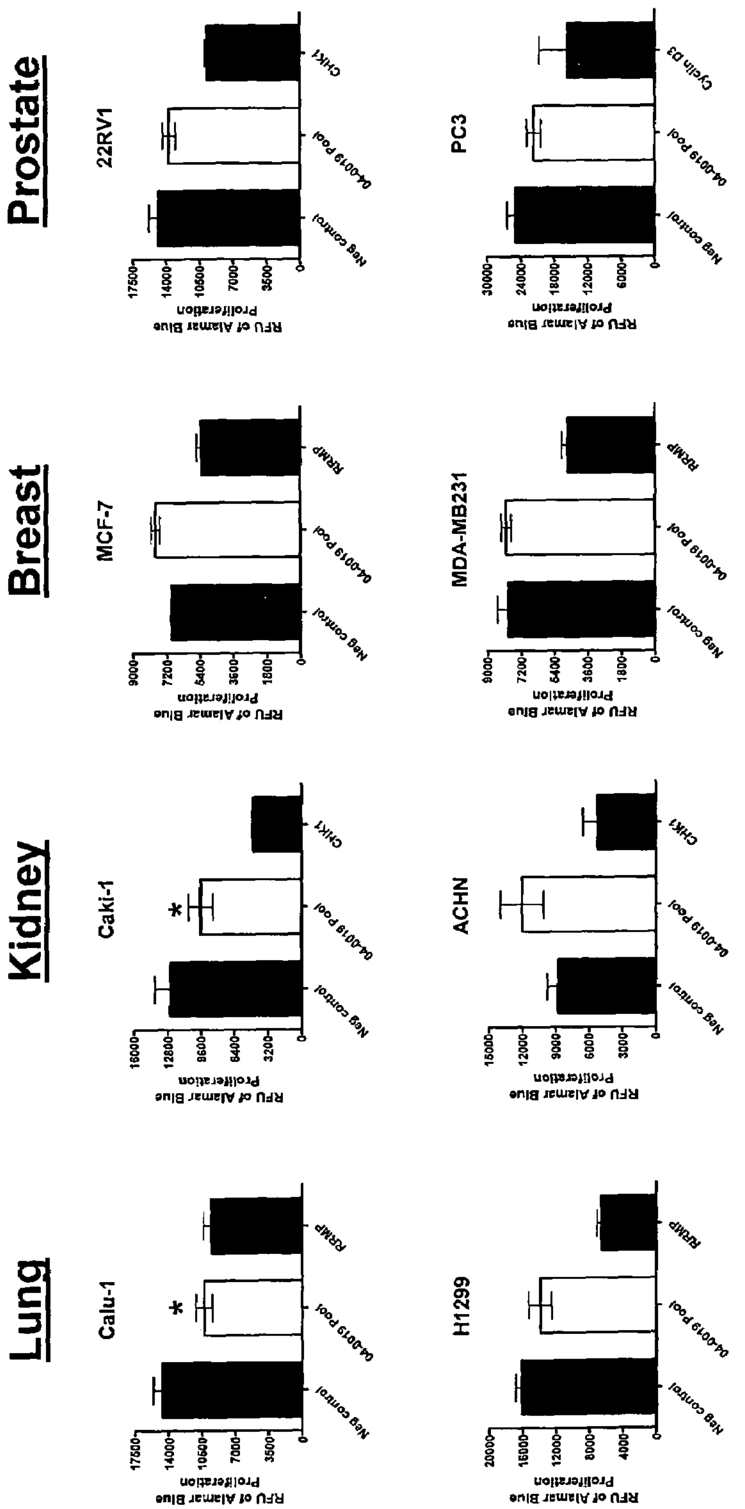

FIG. 6. Knockdown of GFRa1 mRNA Inhibits Proliferation in Lung and Kidney Cancer Cells.

Figure 7:
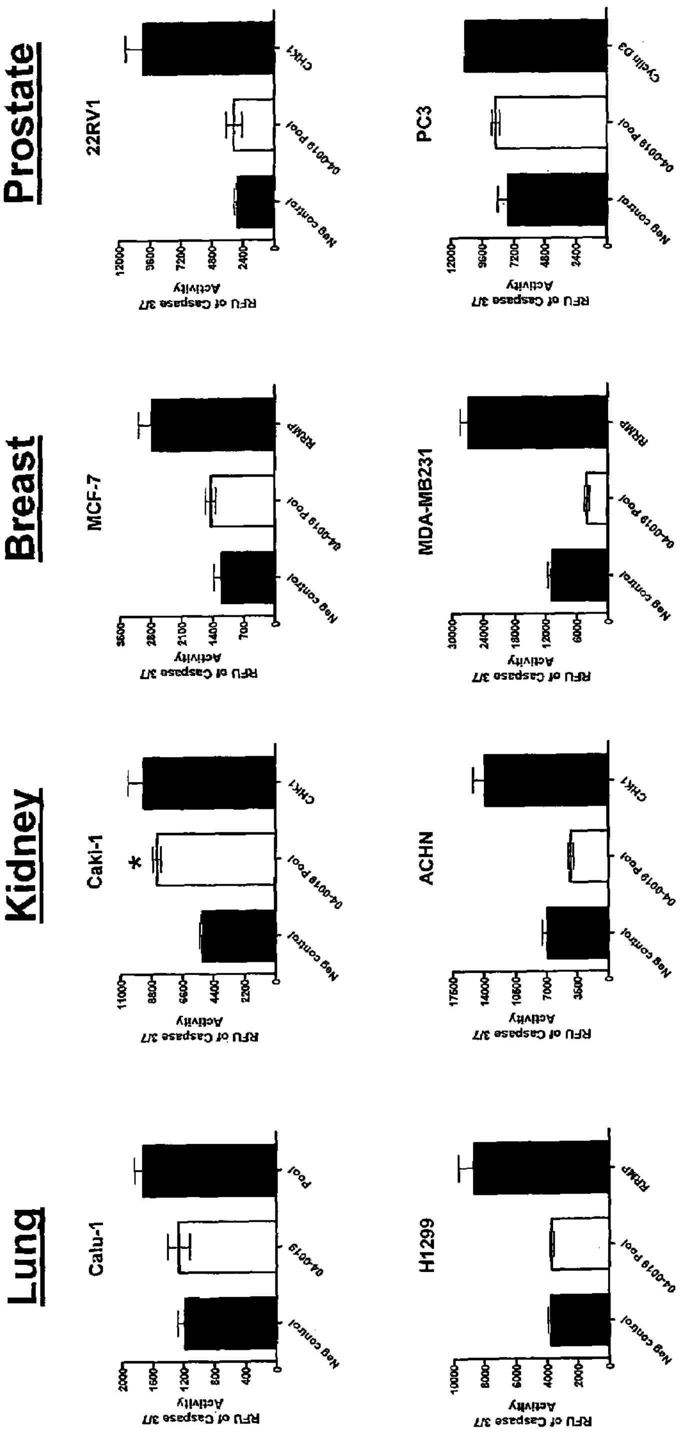

FIG. 7. Knockdown of GFRa1 mRNA Induces Apoptosis in Kidney Cancer Cells.

Figure 8:
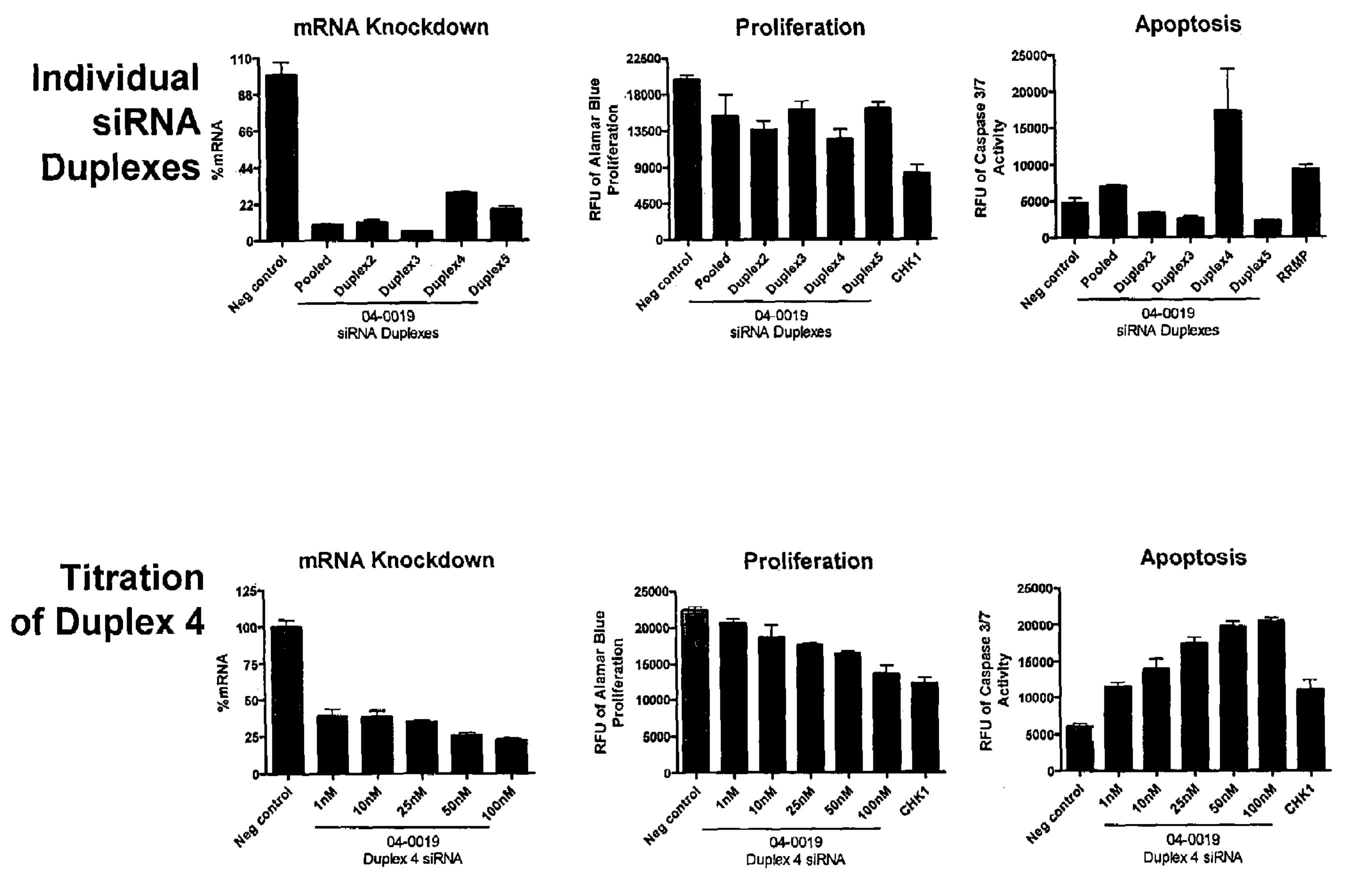

FIG. 8. Knockdown of GFRa1 mRNA Induces Apoptosis and Inhibits Proliferation in Caki-1 Kidney Cancer Cells.

Figure 9:
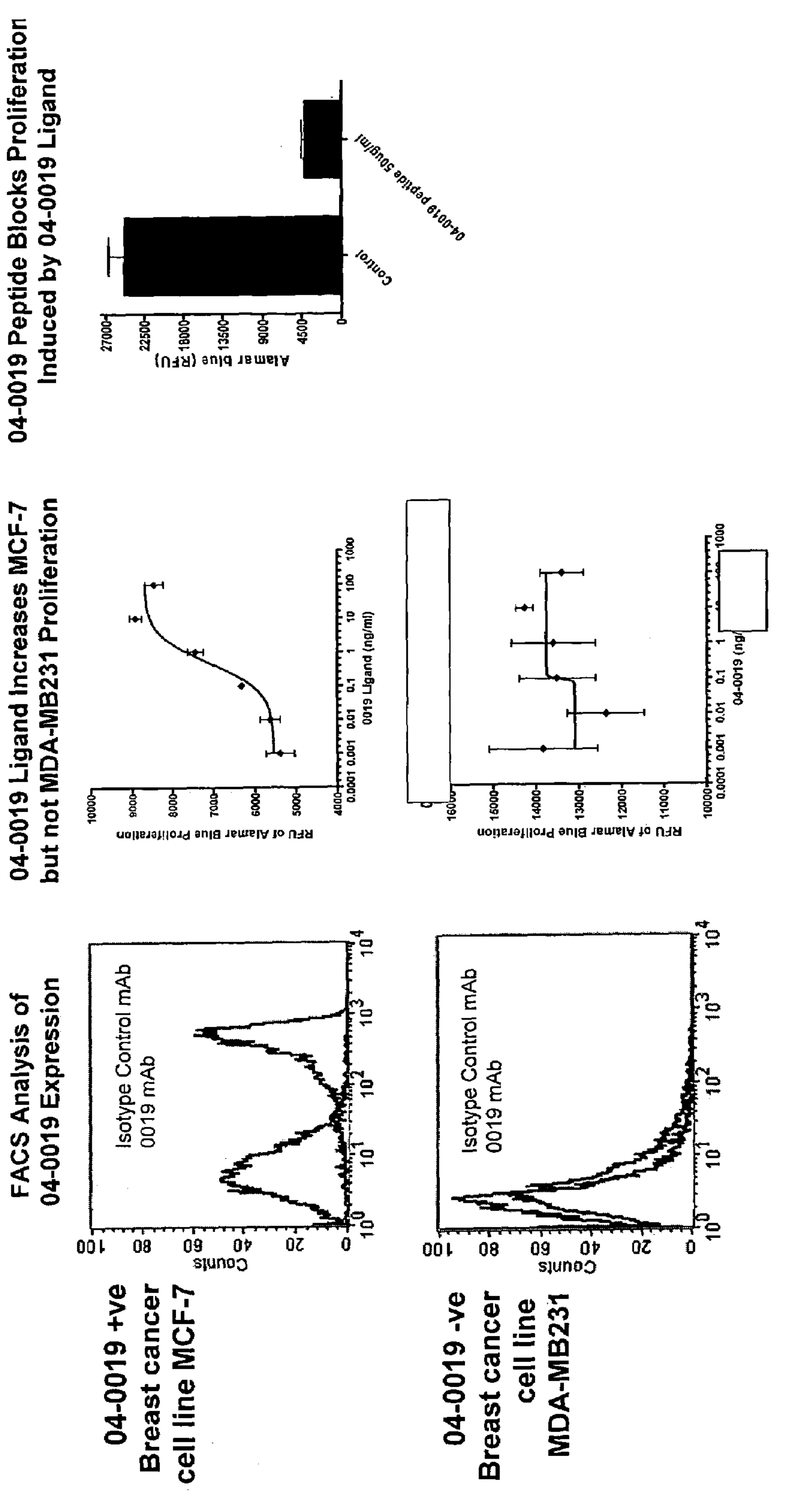

FIG. 9. Ligand of GFRa1 (GDNF) Increases Proliferation of GFRa1 Positive MCF-7 Breast Cancer cells.

Figure 10:
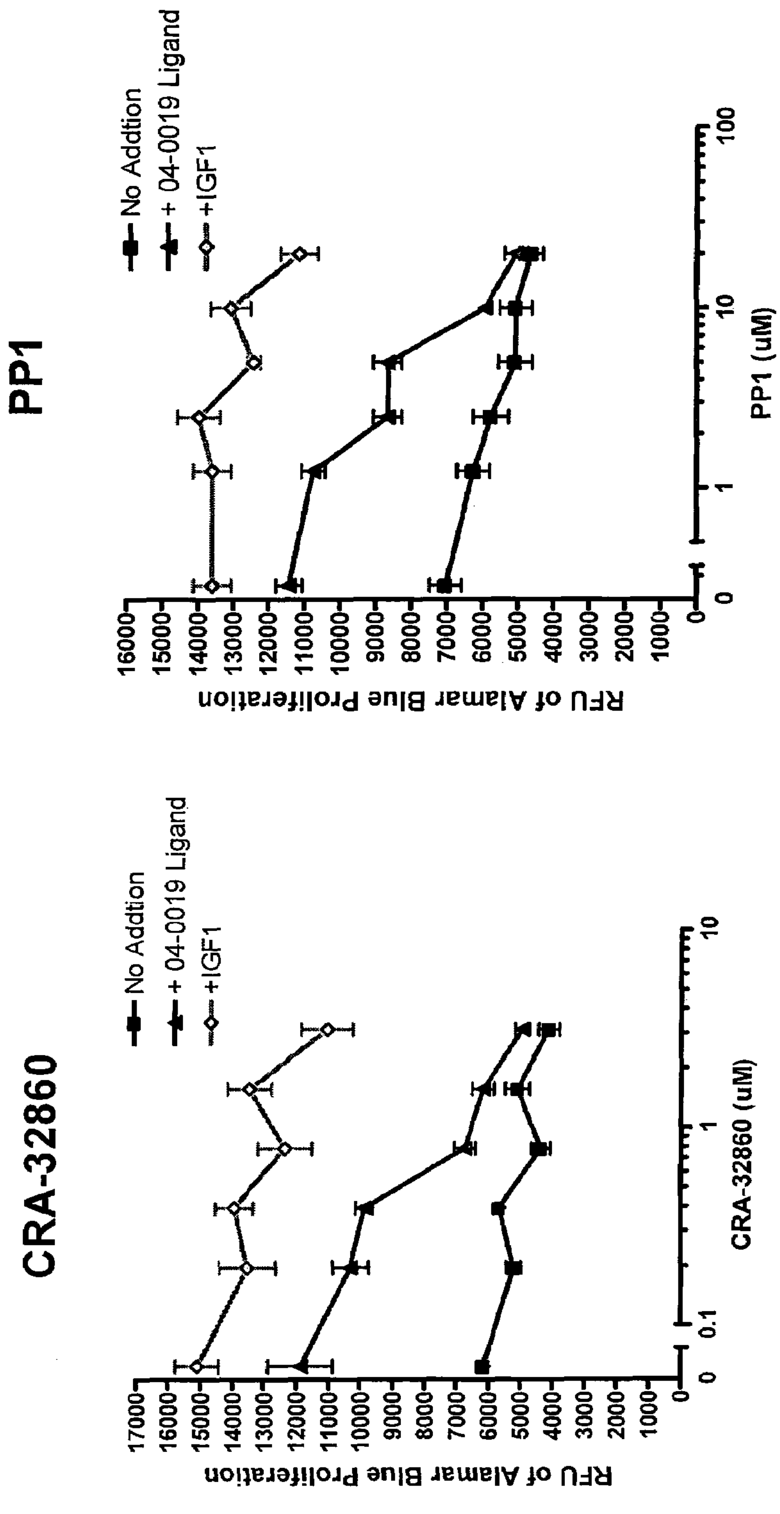

FIG. 10. GFRa1 Kinase Binding Partner (Ret) Kinase Inhibitors Inhibit Proliferation Induced by GFRa1?Ligand (GDNF) in MCF-7 Cells.

FIG. 11. GDNF Ligand IHC.

FIG. 12. Ret Kinase Binding Partner IHC.

FIG. 13. Phosphorylated Ret Kinase Binding Partner IHC.

FIG. 14. Expression in Breast Cancer Specimens.

FIG. 15. Evaluation of Level and Homogeneity of GFRa1 Expression in Tumor Tissues: 1st Ab.

FIG. 16. Evaluation of Level and Homogeneity of GFRa1 Expression in Tumor Tissues: 2nd Ab.

FIG. 17. GFRa1 Ligand is Expressed in MCF-7 cells.

Figure 18:
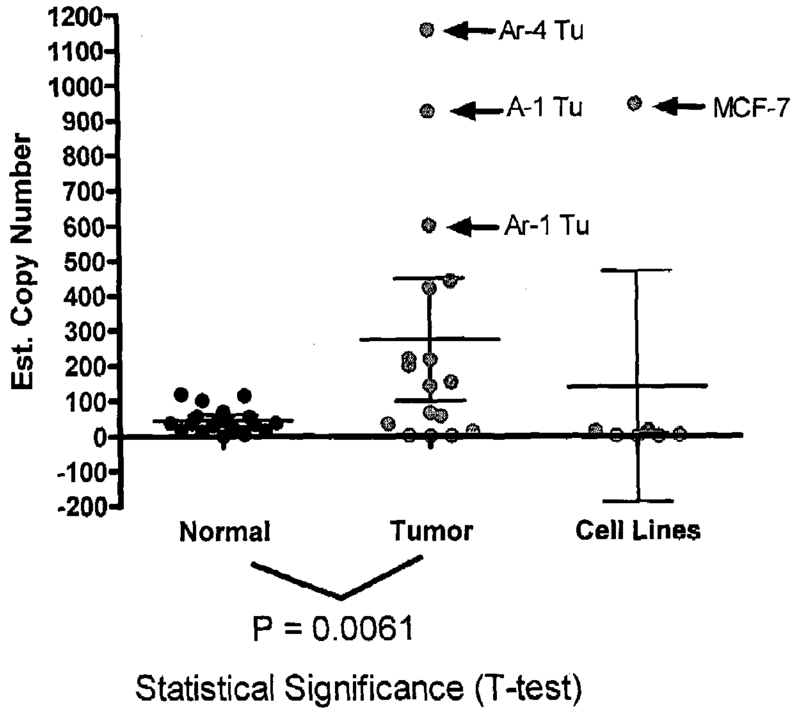

FIG. 18. Overexpression of mRNA for GFRa1 in Breast Tumors.

Figure 19:
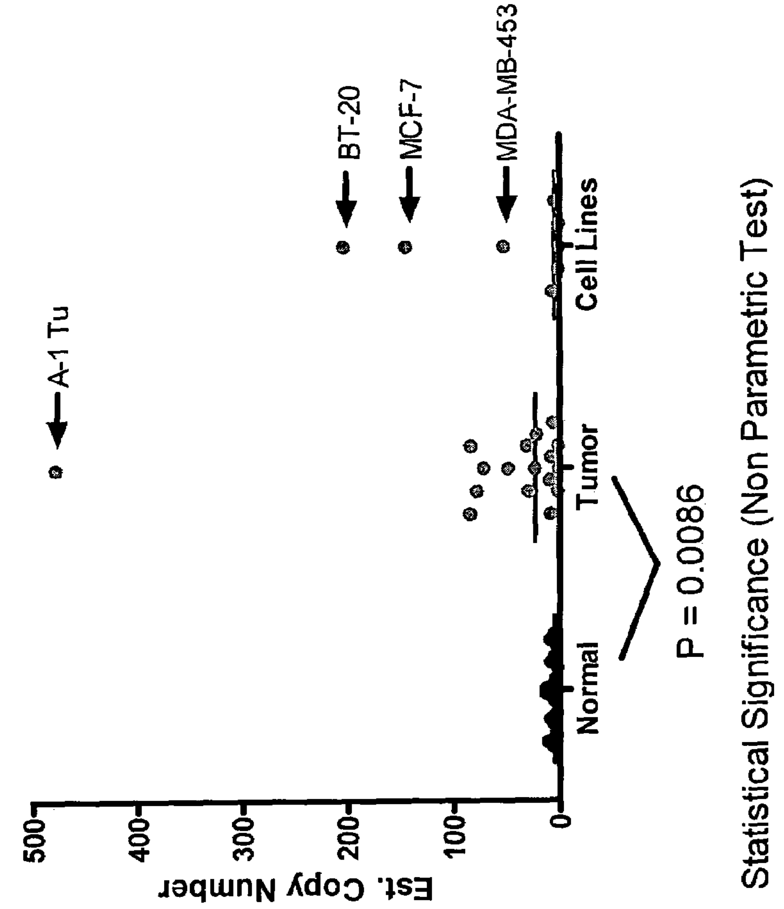

FIG. 19. Overexpression of mRNA for GFRa1 Kinase Binding Partner in Breast Tumors.

Figure 20:
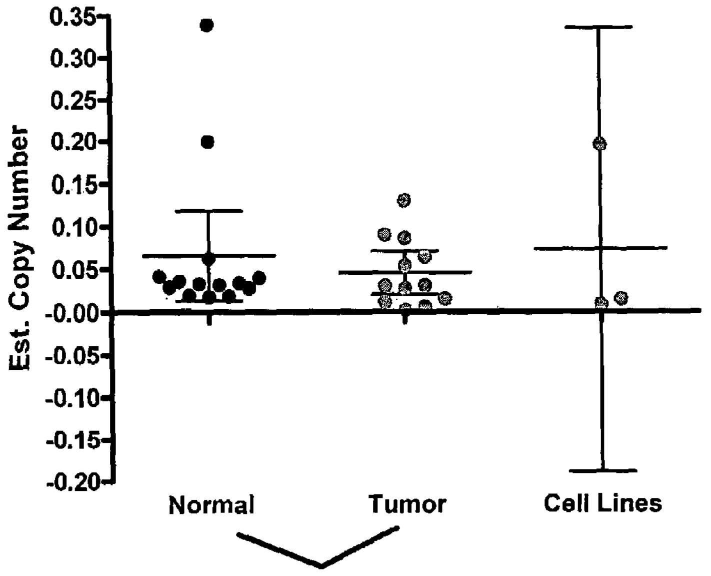

FIG. 20. Overexpression of mRNA for GFRa1 Ligand in Breast Tumors.

Figure 21:
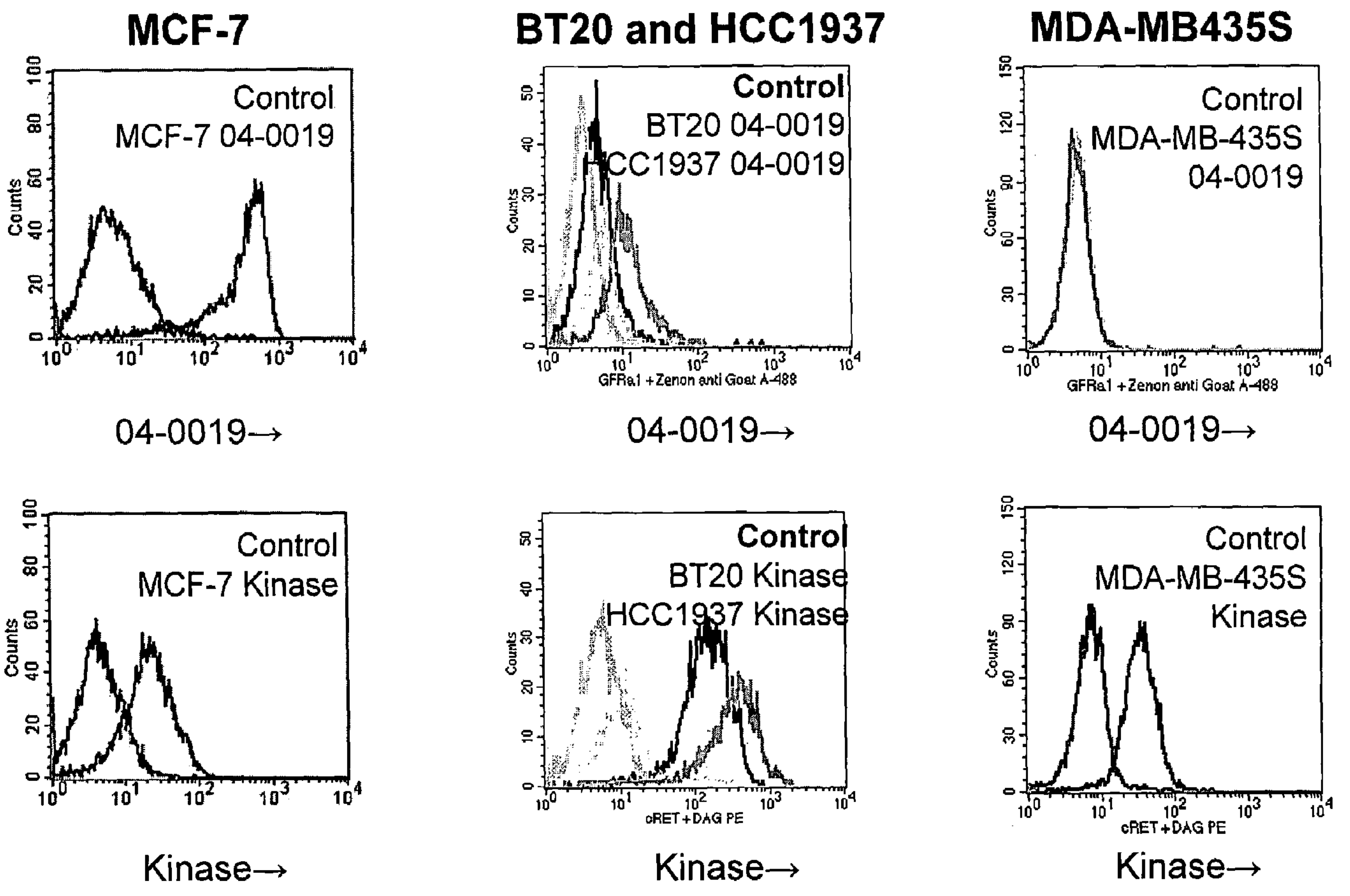

FIG. 21. Both GFRa1 and it's Kinase Binding Partner are Expressed in MCF7 and HCC1937 Breast Cancer Cells.

Figure 22:
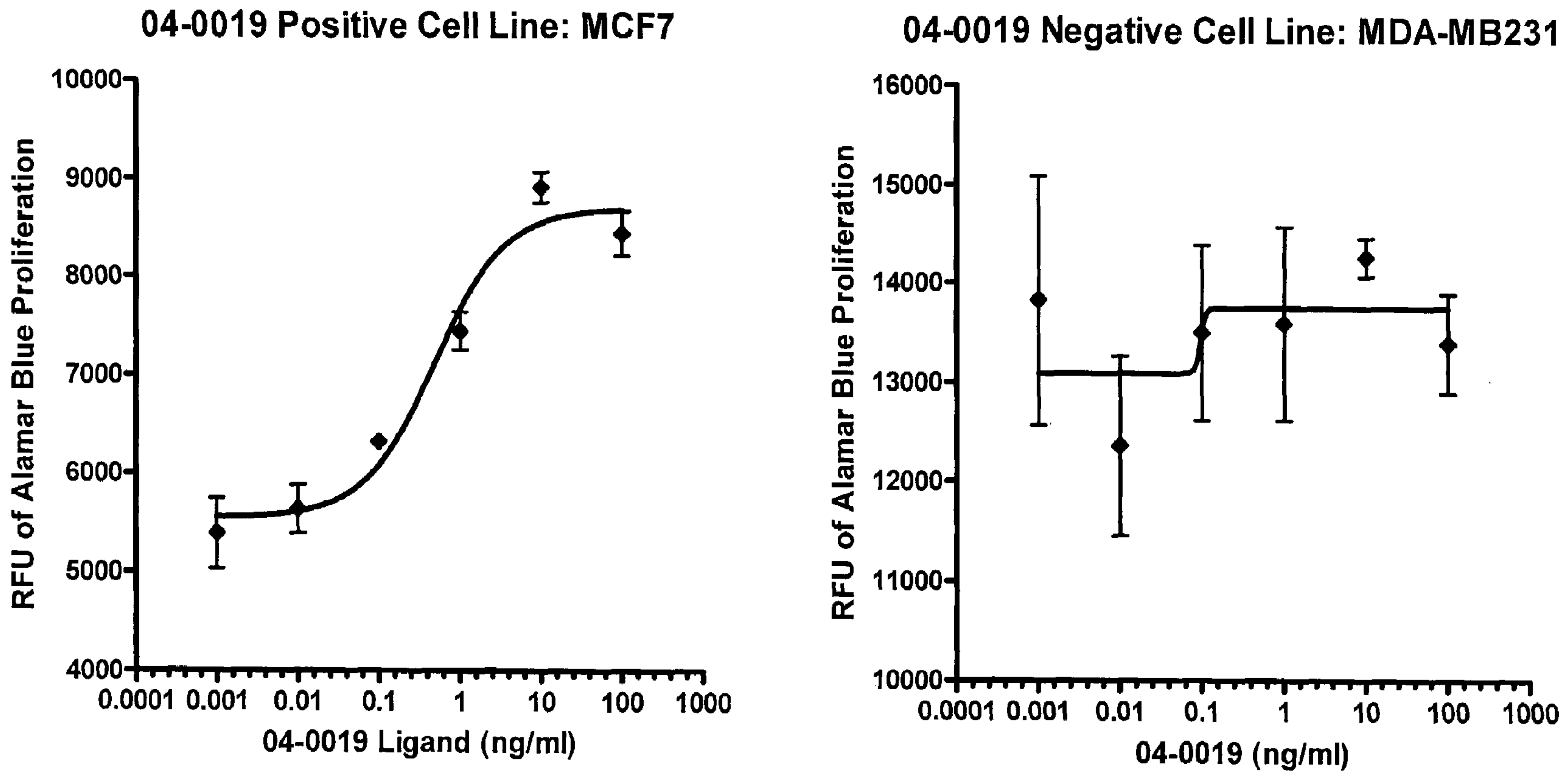

FIG. 22. GFRa1 Ligand Increases Proliferation of GFRa1 Positive MCF-7 Breast Cancer cells.

Figure 23:
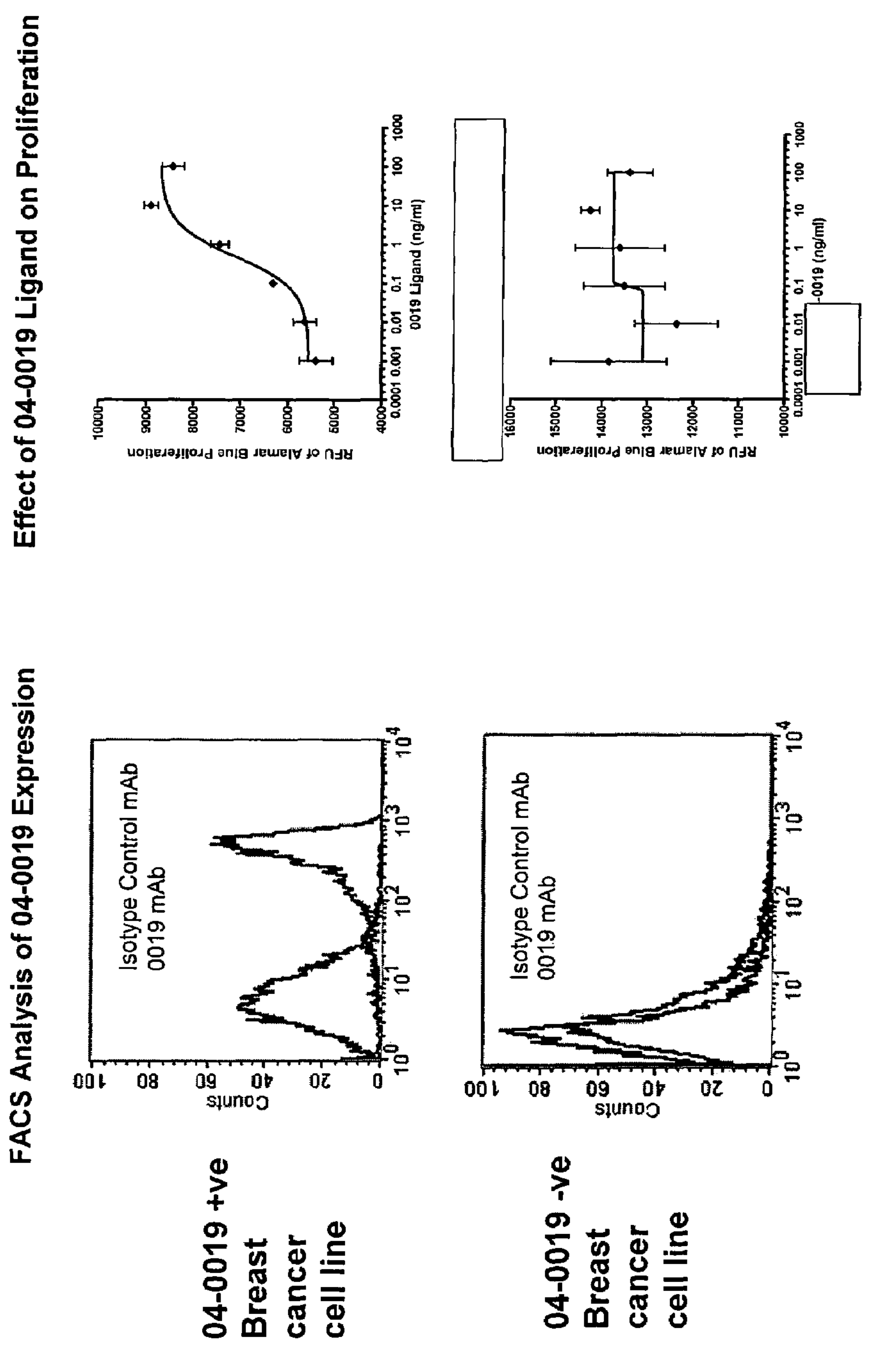

FIG. 23. Ligand of GFRa1 Increases Proliferation of GFRa1 Positive MCF-7 Breast Cancer cells.

Figure 24:
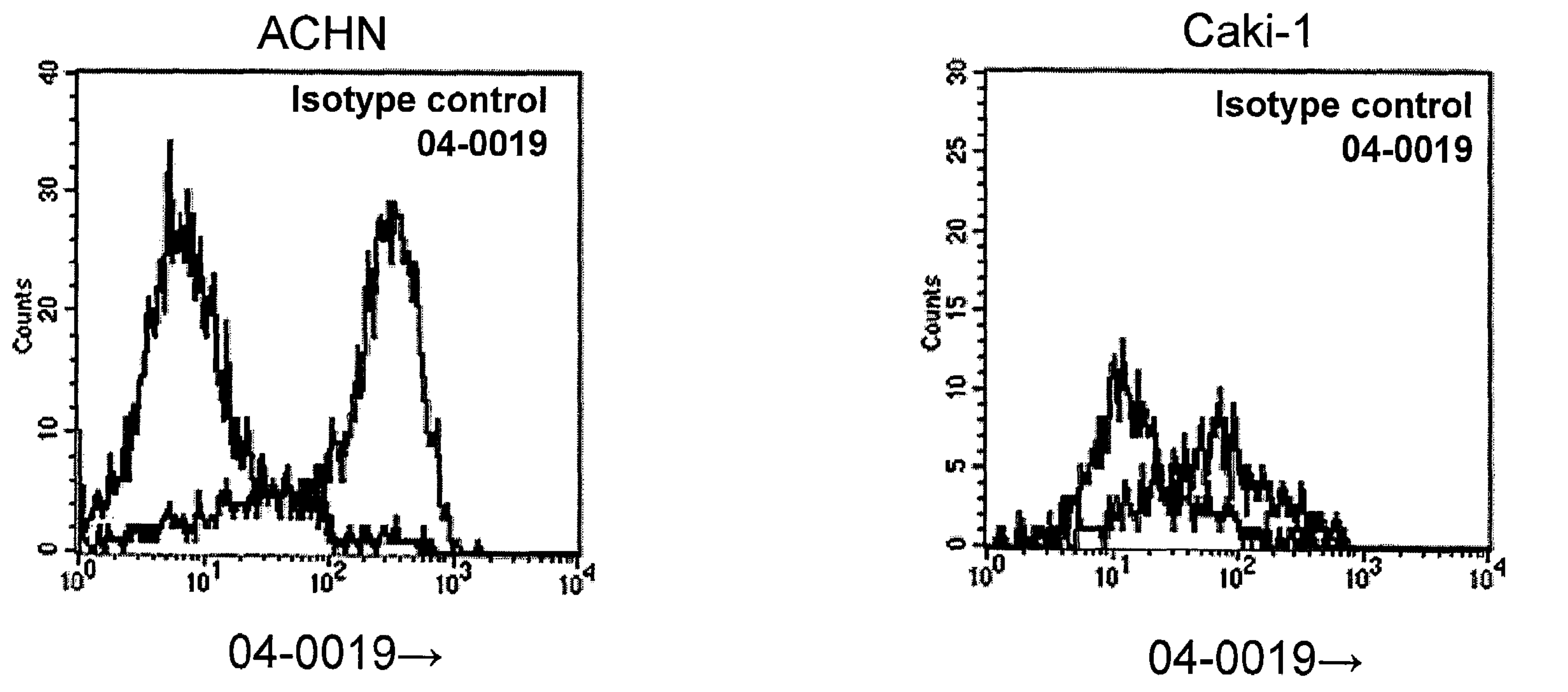

FIG. 24. GFRa1 is Expressed in ACHN and Caki 1 Kidney Cell lines.

Figure 25:
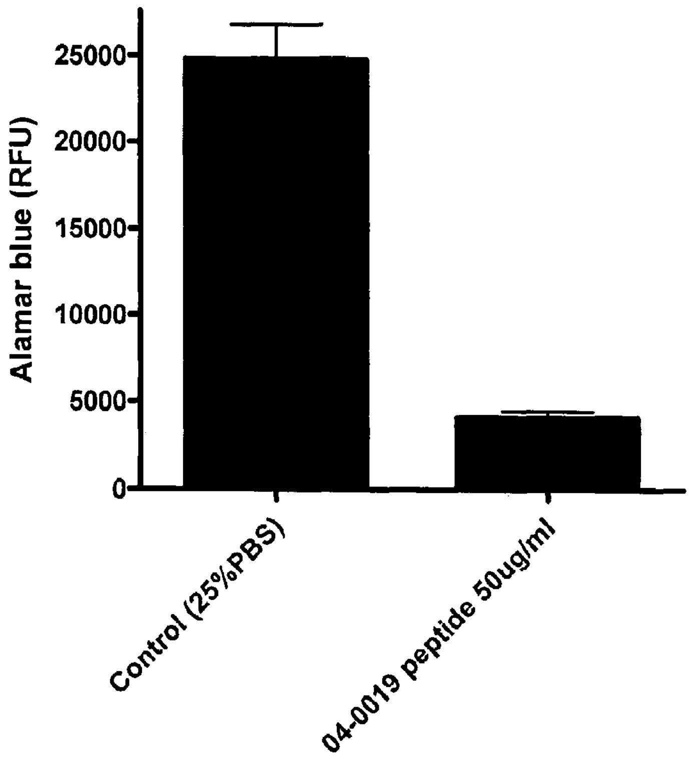

FIG. 25. GFRa1 Peptide Blocks 20 ng/ml GDNF (GFR Ligand) Mediated MCF-7 cell Proliferation.

Figure 26:
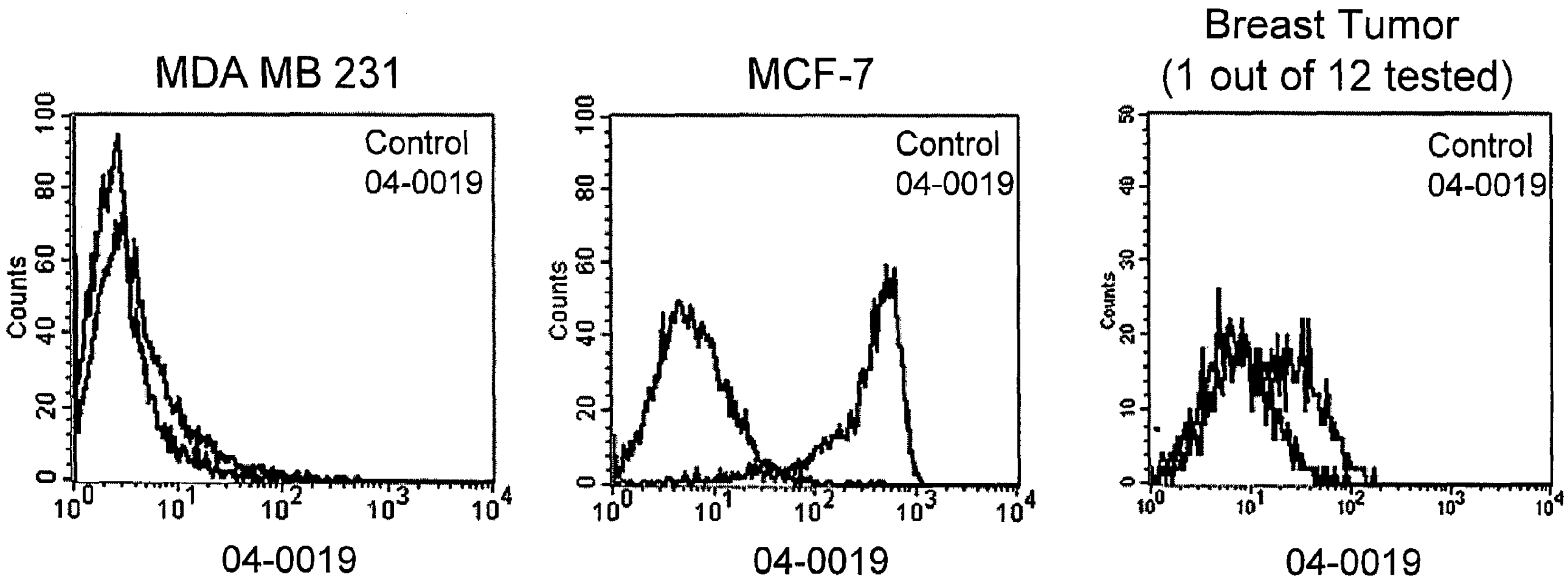

FIG. 26. GFRa1 Expression in Breast Cell Lines and Tumors.

Figure 27:
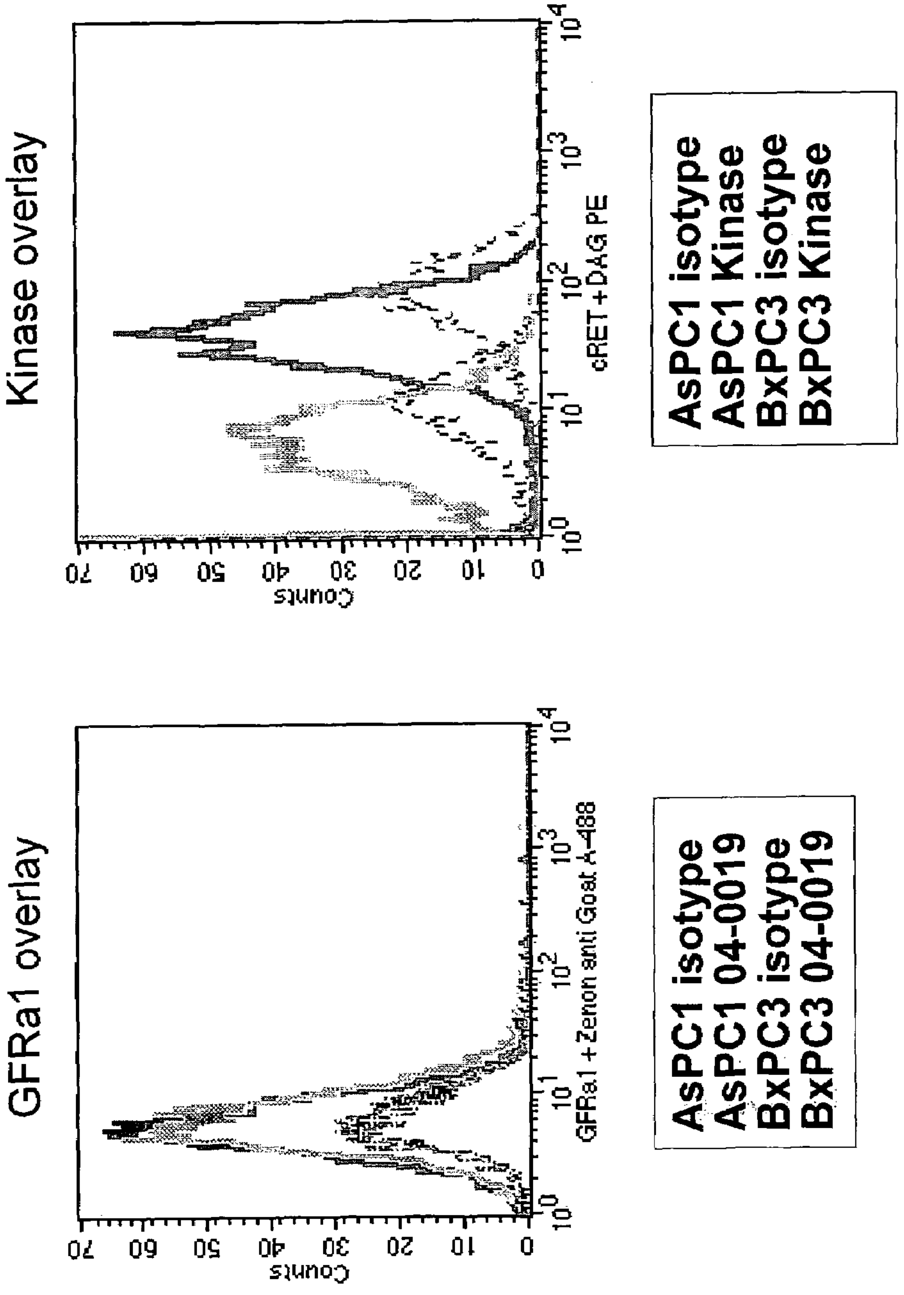

FIG. 27. GFRa1 Kinase Binding Partner but not GFRa1 is Expressed in ASPC-1 and BXPC-3 Pancreatic Cancer Cells.

Figure 28:
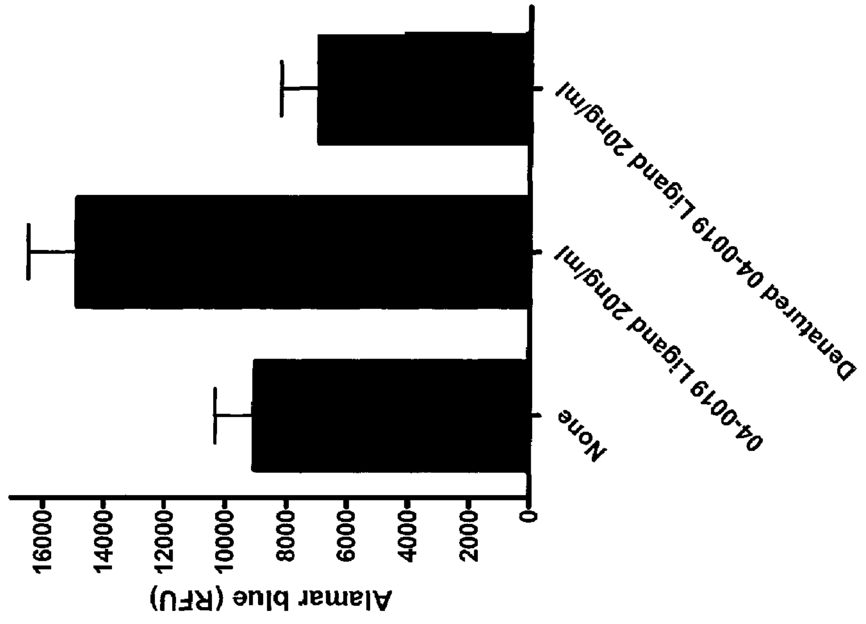

FIG. 28. Heat Denatured GFRa1 Ligand Does not Induce MCF-7 cell Proliferation.

Figure 29:
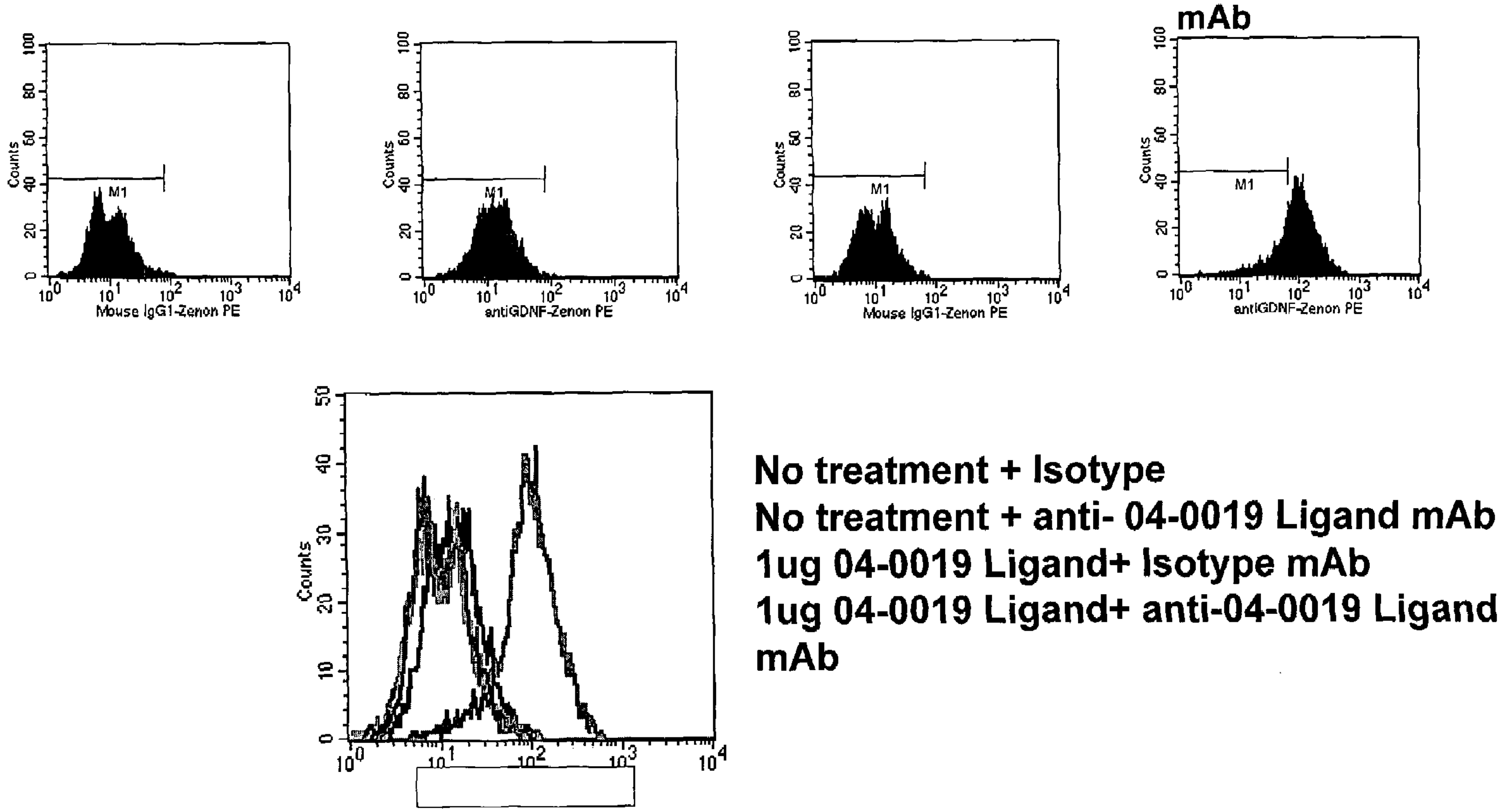

FIG. 29. GFRa1 Ligand Binding on MCF-7 Breast Cancer Cells.

FIG. 30. GFRa1 Ligand mAb Blocks Binding of GFRa1 Ligand.

Figure 31:
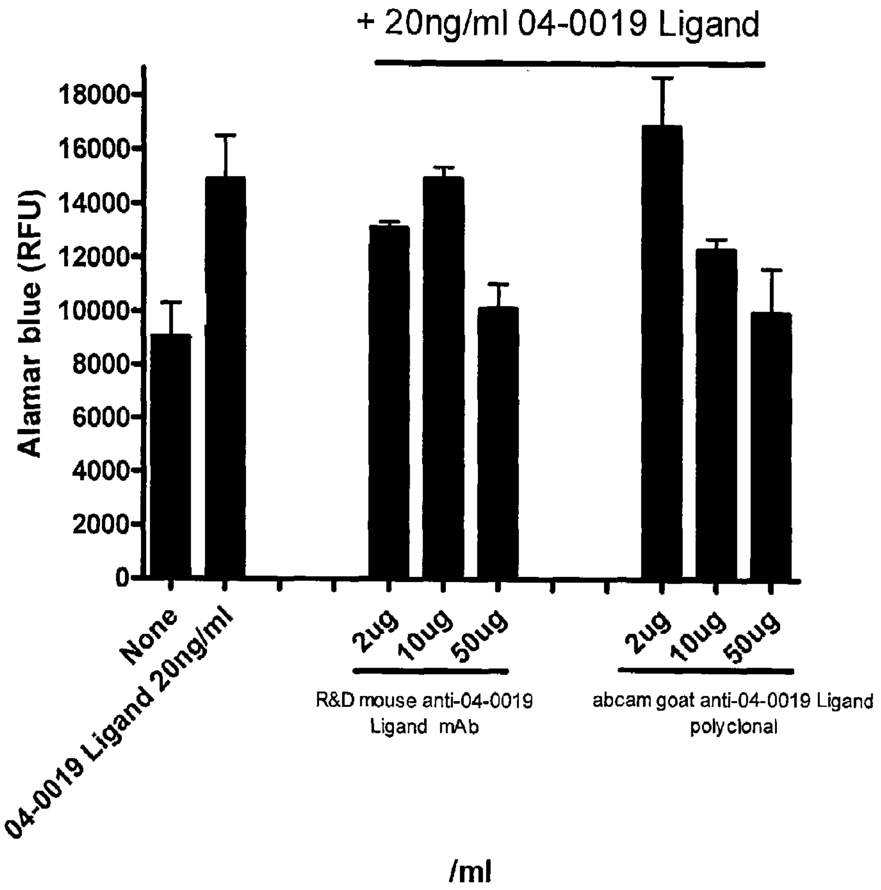

FIG. 31. GFRa1 Ligand-Mediated MCF-7 cell Proliferation Is Blocked by Neutralizing anti-GFRa1 Ligand Ab.

Figure 32:
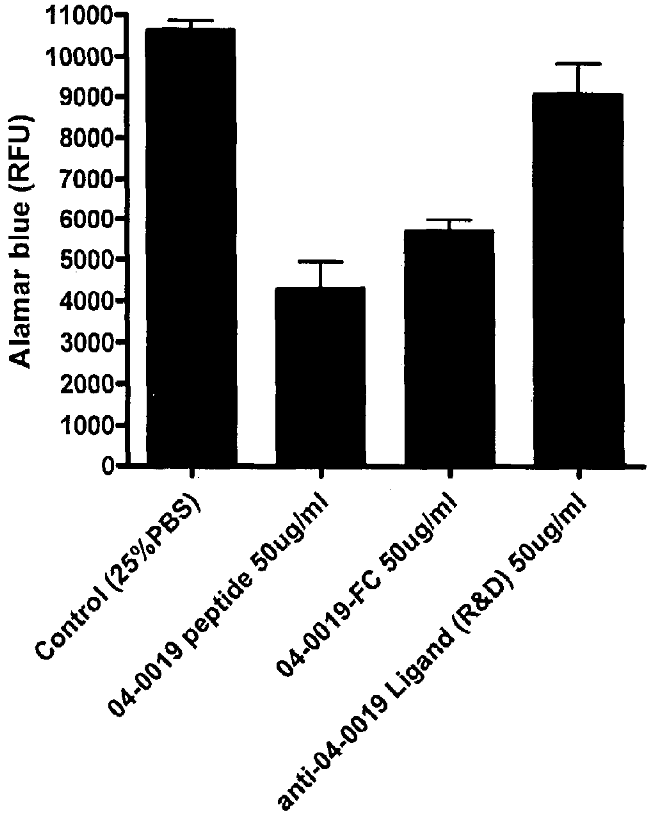

FIG. 32. Effect of GFRa1 Ligand/GFRa1 Antagonists on MCF-7 Proliferation in Complete Growth Medium (No Exogenous GFRa1 Ligand).

Figure 33:
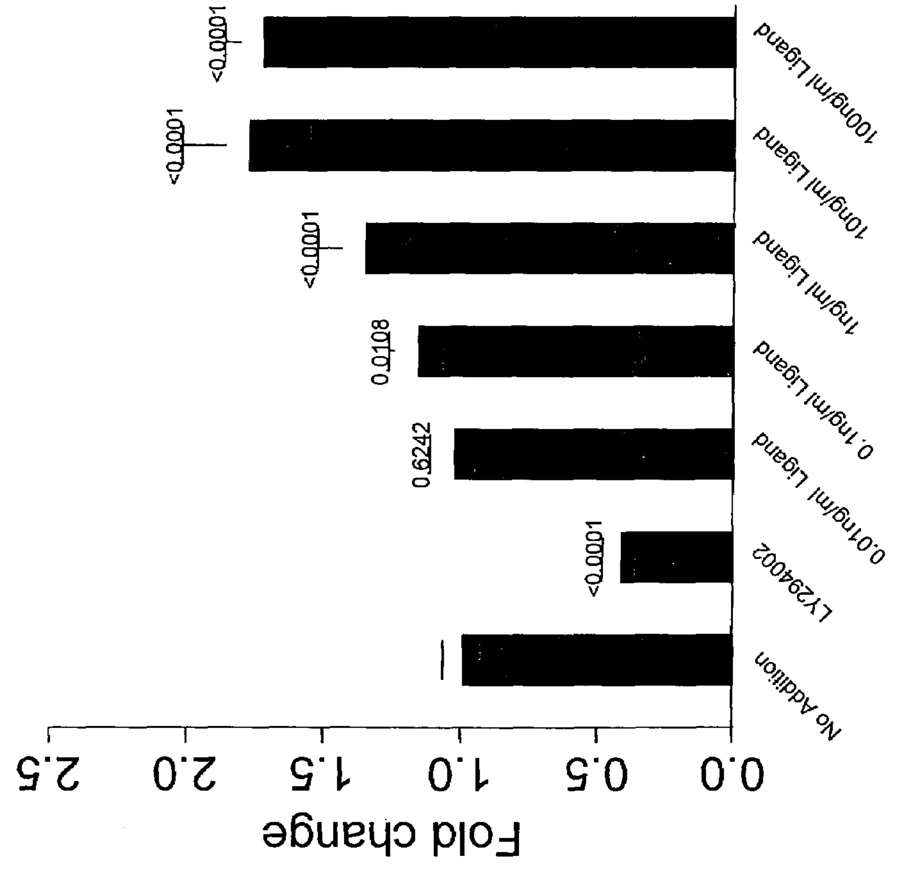

FIG. 33. GFRa1 Ligand (GDNF) Increases Proliferation of MCF-7 Breast Cancer cells in a Statistically Significant Manner (n=3).

FIG. 34. mRNA sequence of GFRa1, indicating siRNA target regions.

Claudin-4

FIG. 35. Claudin-4 is Expressed at Cell Surface in Multiple Tumor Types, as indicated by IHC.

ASCT2

FIG. 36. ASCT2 is Over-expressed in Multiple Tumor Types.

Figure 37:
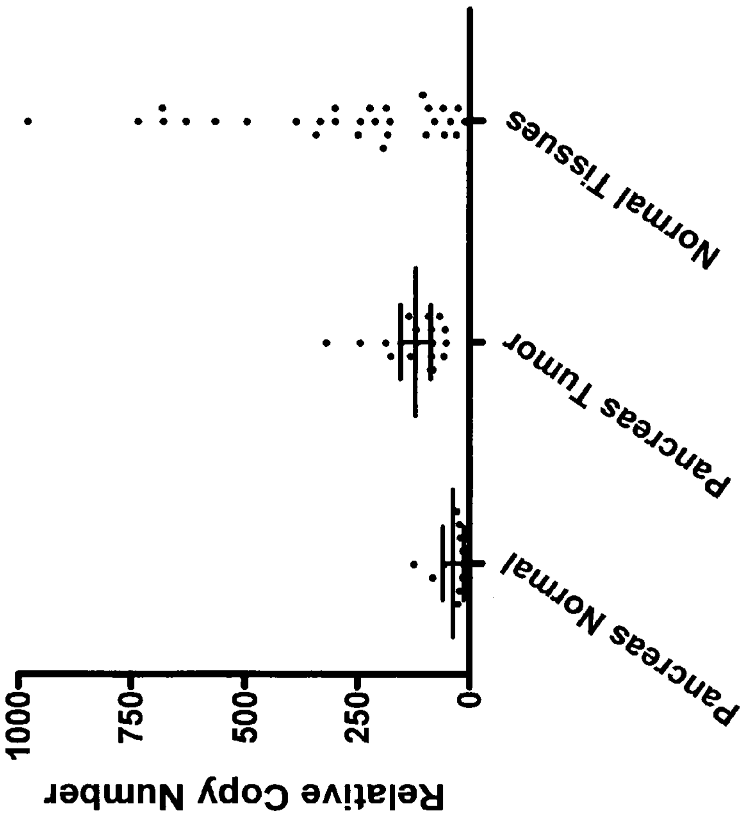

FIG. 37. ASCT2 mRNA Expression Analysis in Pancreatic Tumors.

Figure 38:
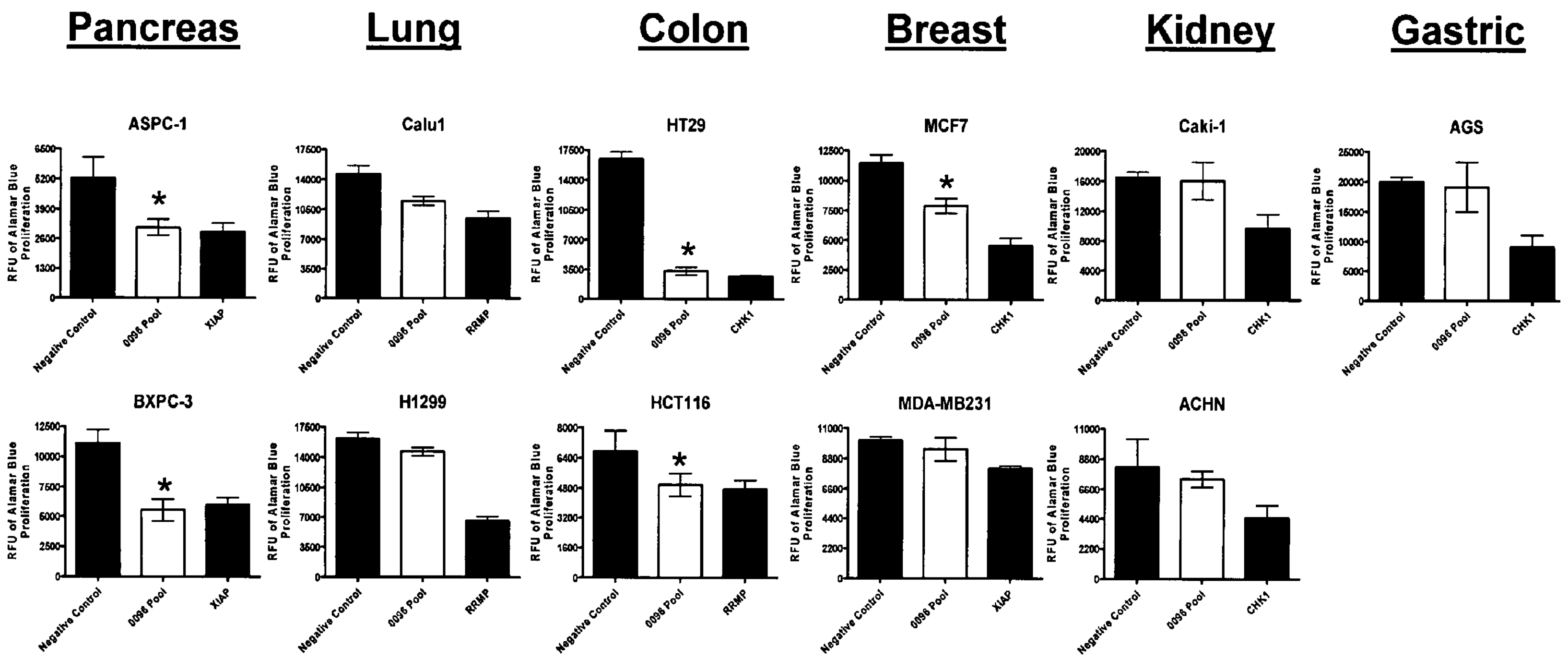

FIG. 38. Knockdown of ASCT2 mRNA Inhibits Proliferation in Pancreatic, Colon and Breast Cancer Cells.

Figure 39:
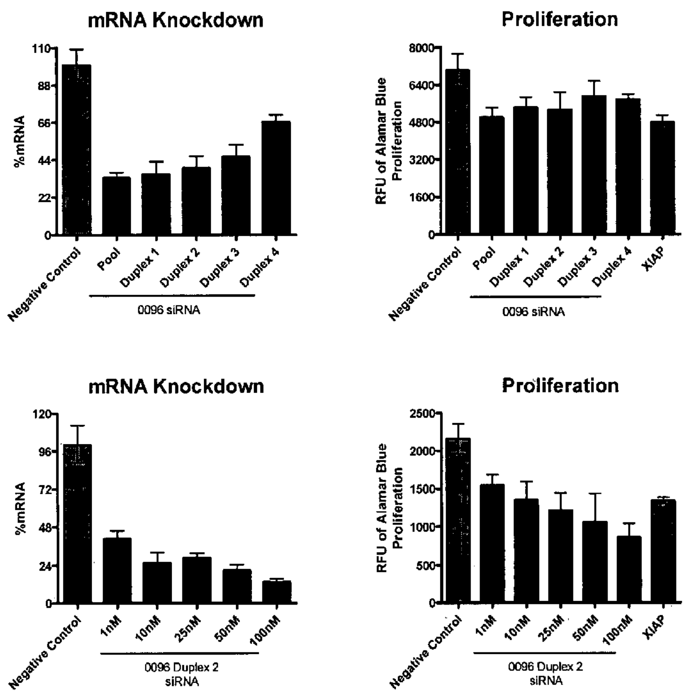

FIG. 39. Knockdown of ASCT2 mRNA Inhibits Proliferation in ASPC-1 Pancreatic Cancer Cells.

Figure 40:
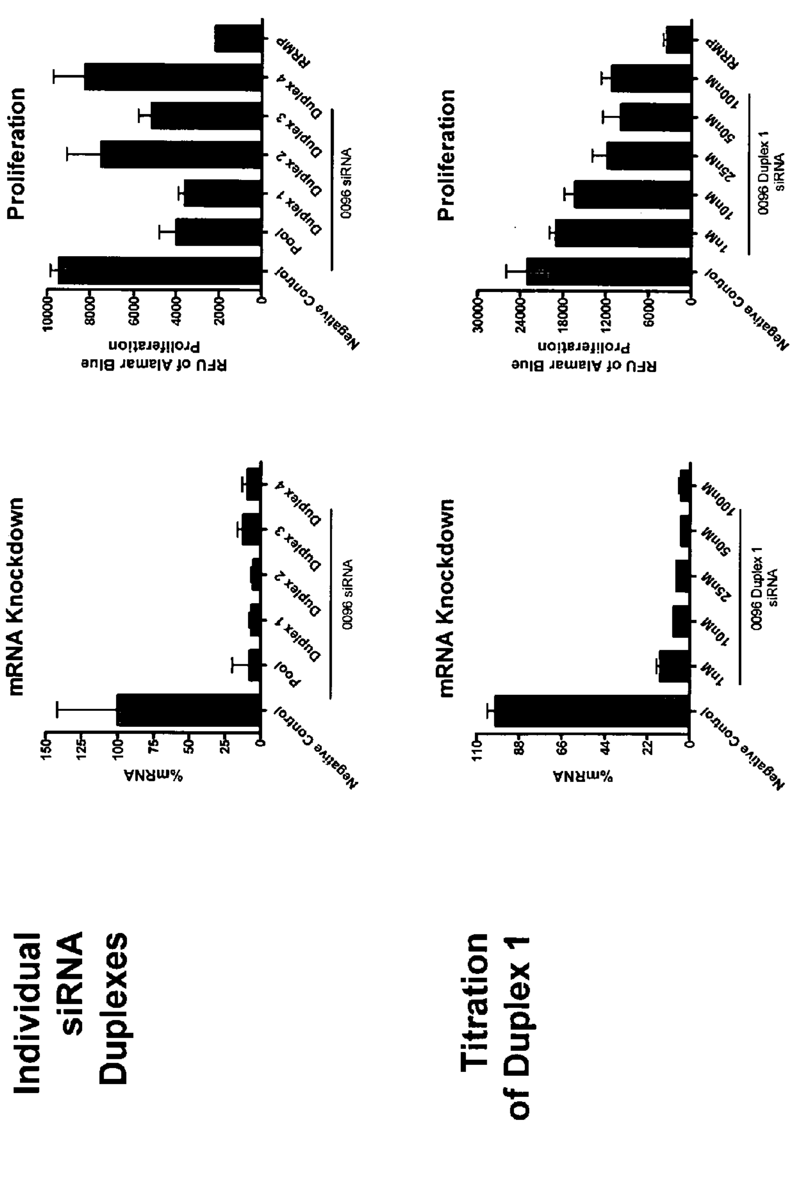

FIG. 40. Knockdown of ASCT2 mRNA Inhibits Proliferation in HT29 Colon Cancer Cells.

FIG. 41. ASCT2 mRNA sequence, indicating siRNA target regions.

CD166 (ALCAM)

FIG. 42. CD166 is Overexpressed in Multiple Tumor Types.

Figure 43:
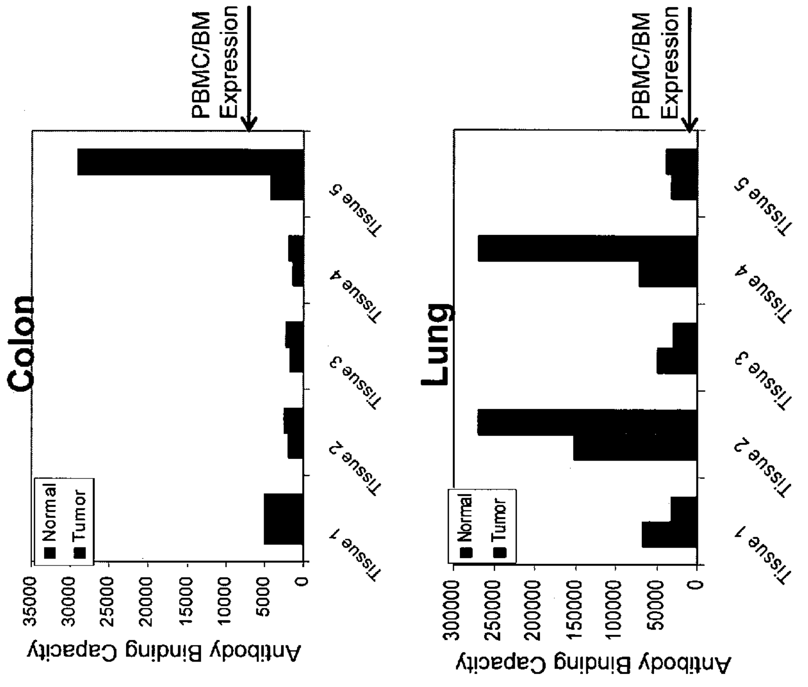

FIG. 43. CD166 Overexpression in Tissues by Q-FACS.

Figure 44:
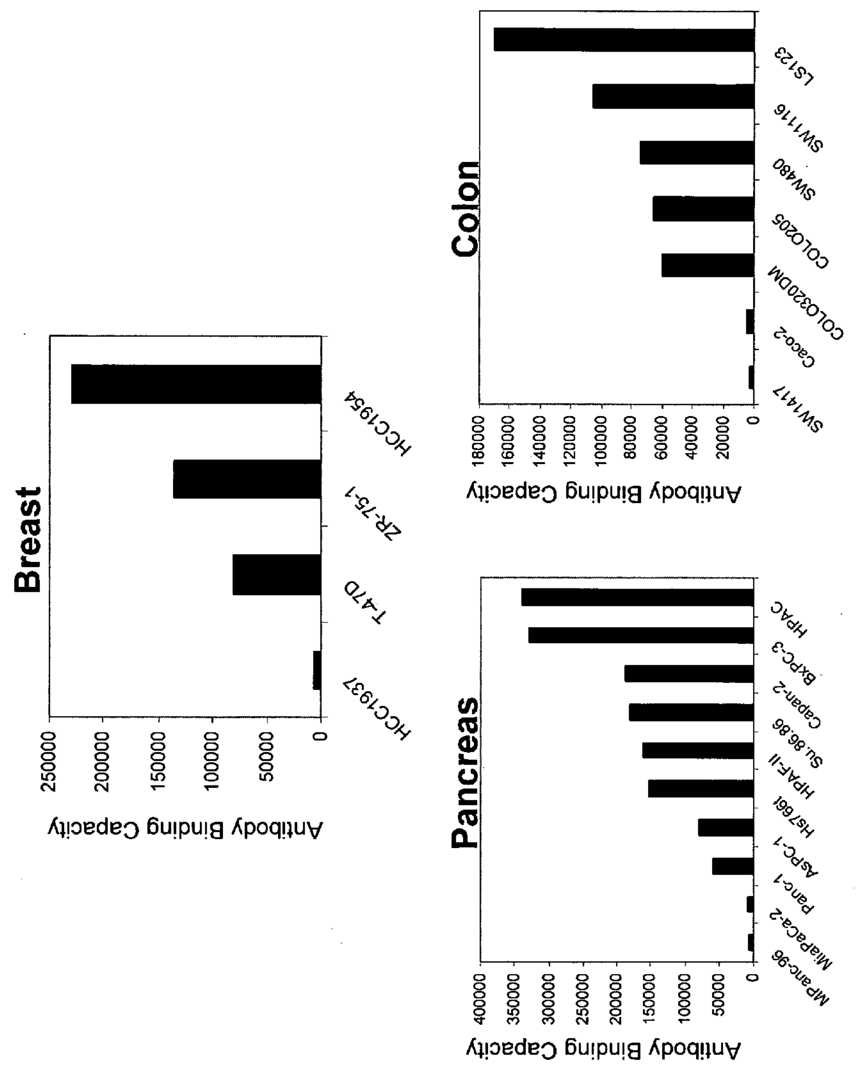

FIG. 44. CD166 Overexpression in Cell Lines by Q-FACS.

Figure 45:
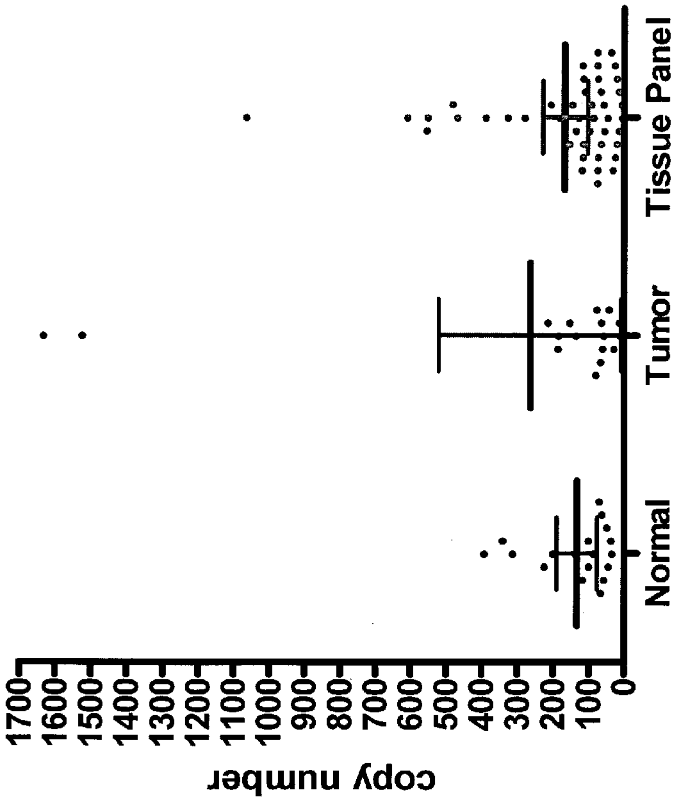

FIG. 45. CD166 mRNA Expression—Breast Normal/Tumor Panel.

Figure 46:
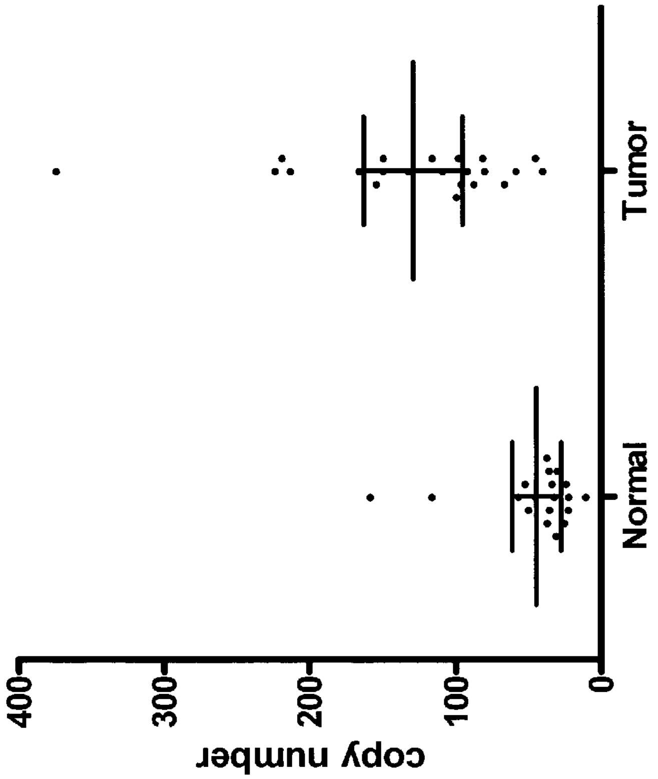

FIG. 46. CD166 mRNA Expression—Colon Normal/Tumor Panel.

Figure 47:
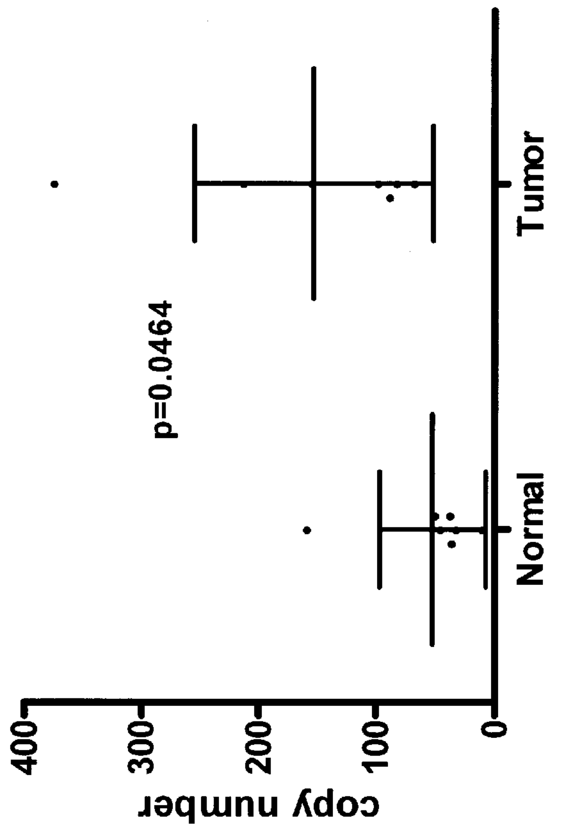

FIG. 47. CD166 mRNA Expression Matched Colon Normal/Tumor Panel.

Figure 48:
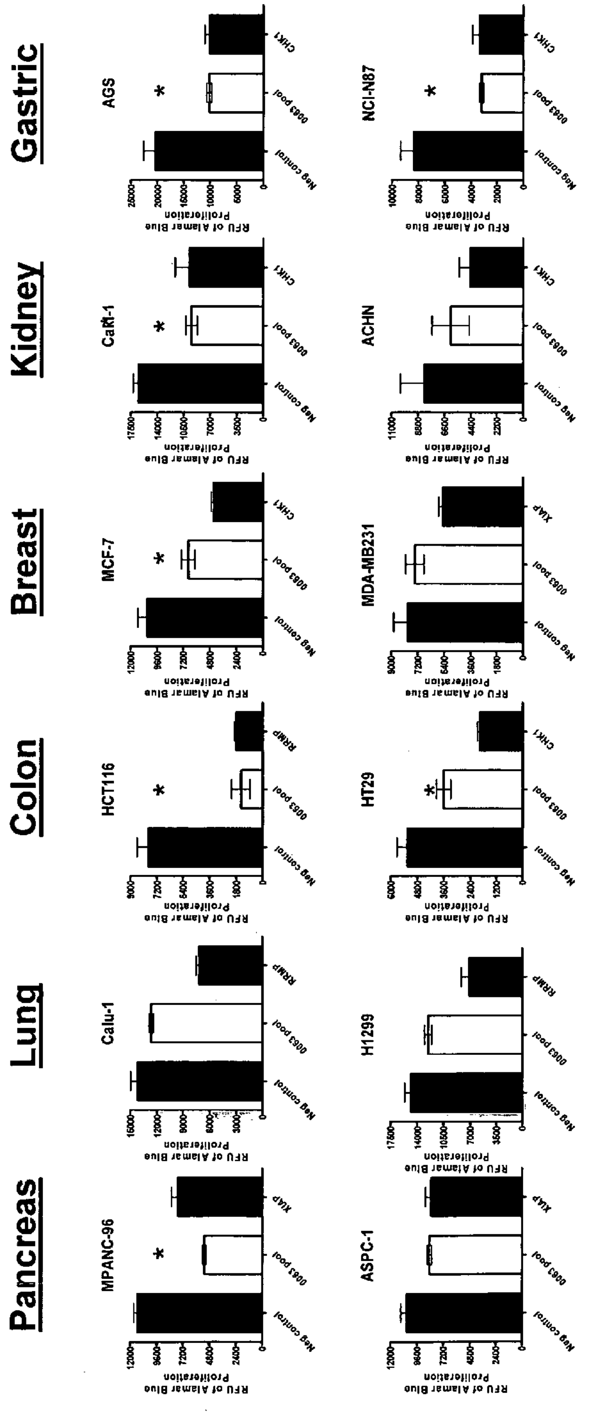

FIG. 48. RNAi Knockdown of CD166 mRNA Inhibits Proliferation in Multiple Cancer Cells.

Figure 49:
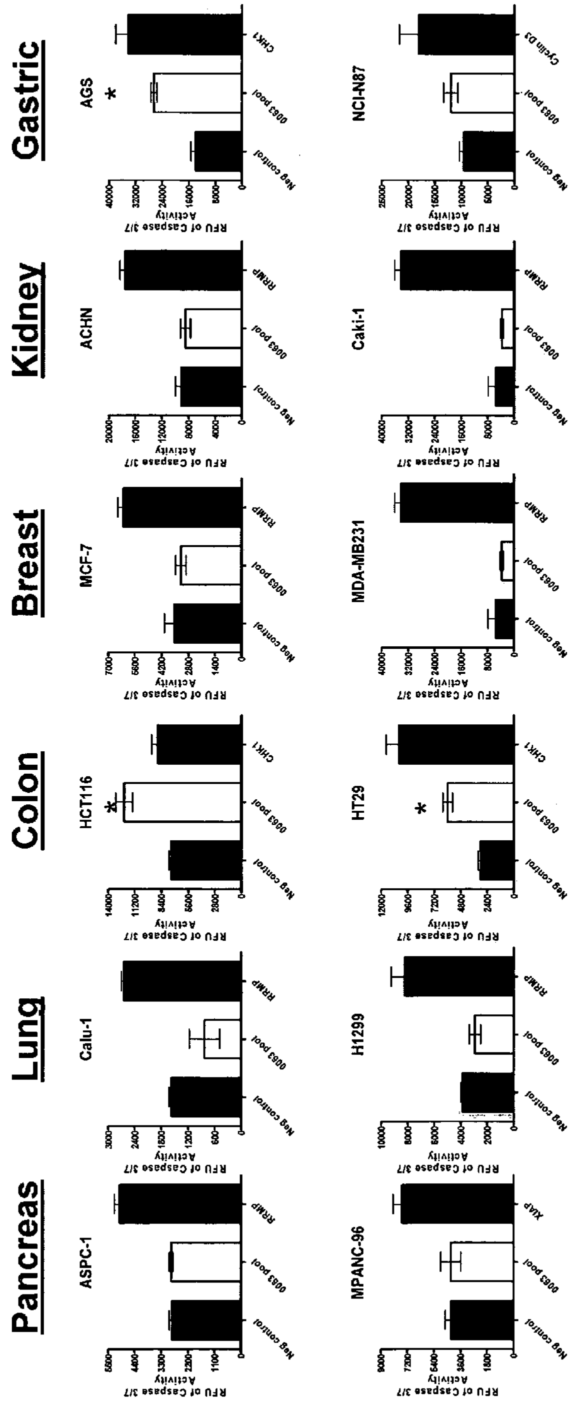

FIG. 49. RNAi Knockdown of CD166 mRNA Induces Apoptosis in Colon and Gastric Cancer Cells.

Figure 50:
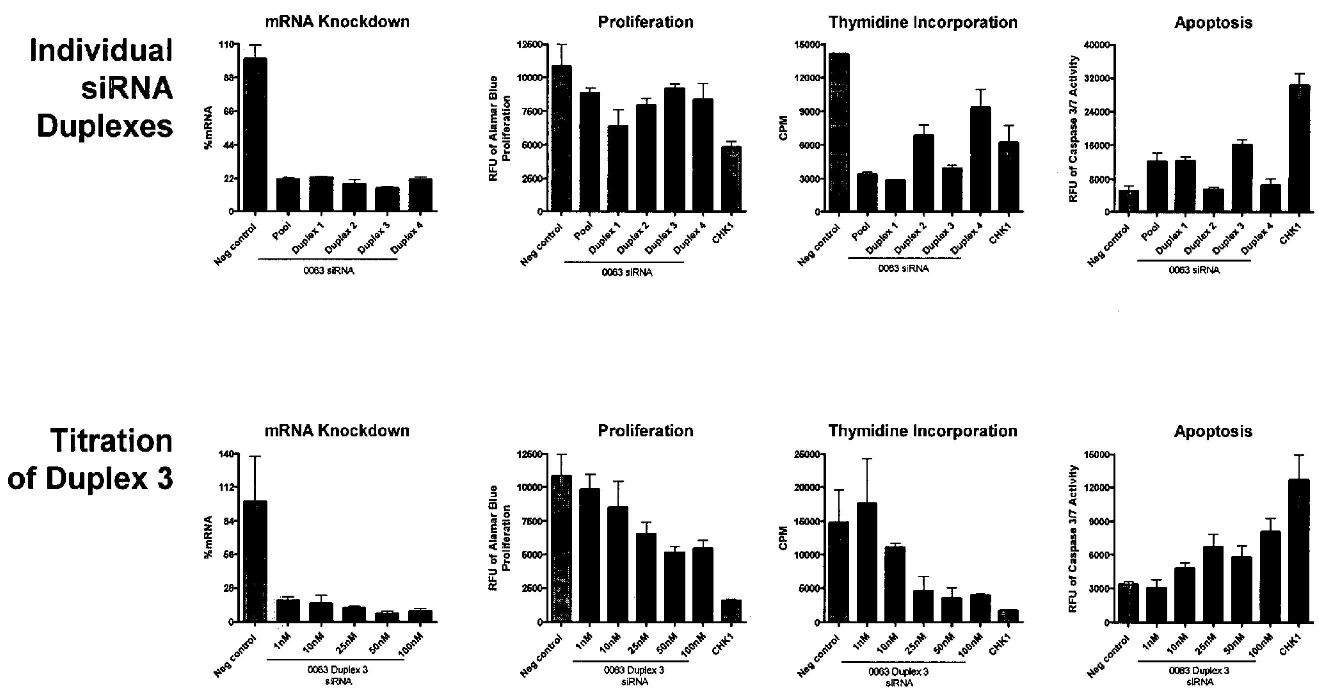

FIG. 50. RNAi Knockdown of CD166 mRNA Inhibits Proliferation and Induces Apoptosis in HT29 Colon Cancer Cells.

FIG. 51. RNAi Knockdown of CD166 mRNA Inhibits Proliferation in ASPC-1 Pancreatic Cancer Cells.

FIG. 52. RNAi Knockdown of CD166 mRNA Inhibits Proliferation and Induces Apoptosis in Caki-1 Kidney Cancer Cells.

Figure 53:
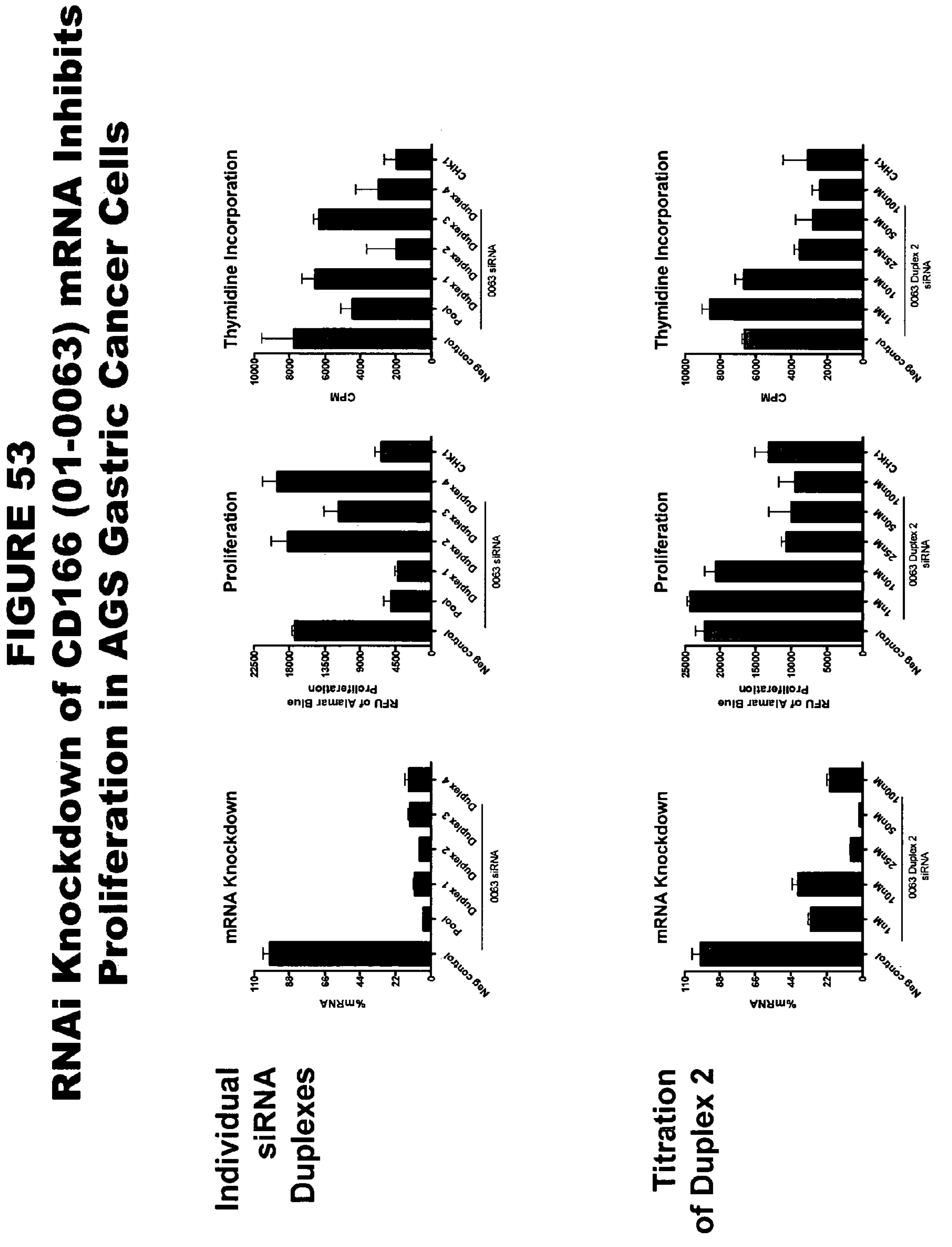

FIG. 53. RNAi Knockdown of CD166 mRNA Inhibits Proliferation in AGS Gastric Cancer Cells.

Figure 54:
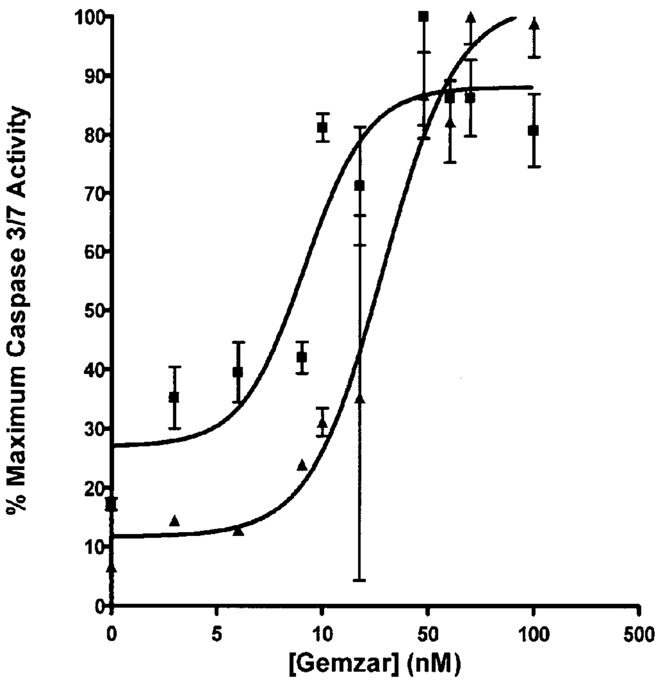

FIG. 54. CD166 siRNA in Combination with Gemzar Increases Apoptosis of BXPC-3 Pancreatic Cancer Cells.

Figure 55:
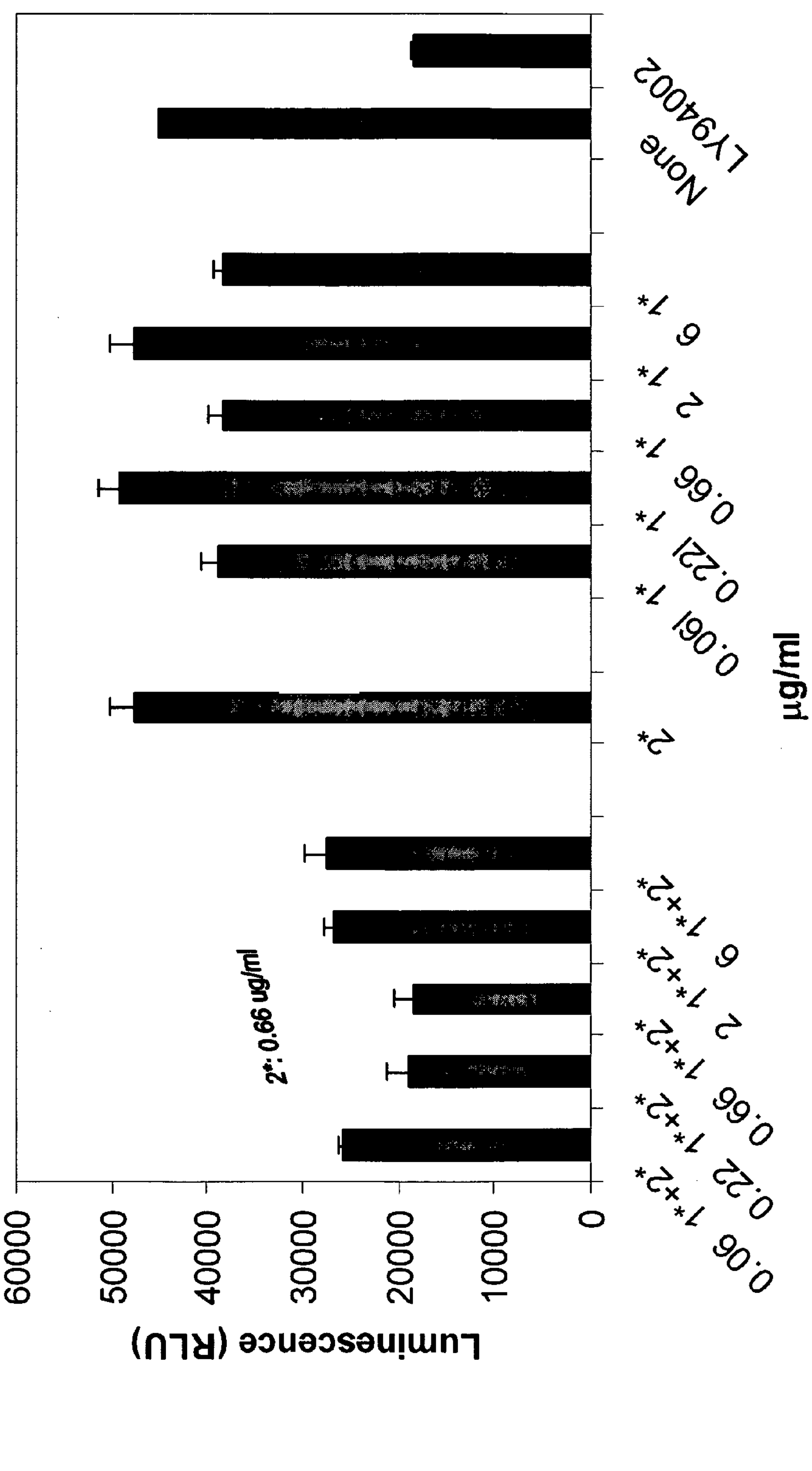

FIG. 55. Saporin-Conjugated 2nd Ab+CD166 mAb Induces Cell Death in CD166 Positive HCC1954 Breast Cells.

Figure 56:
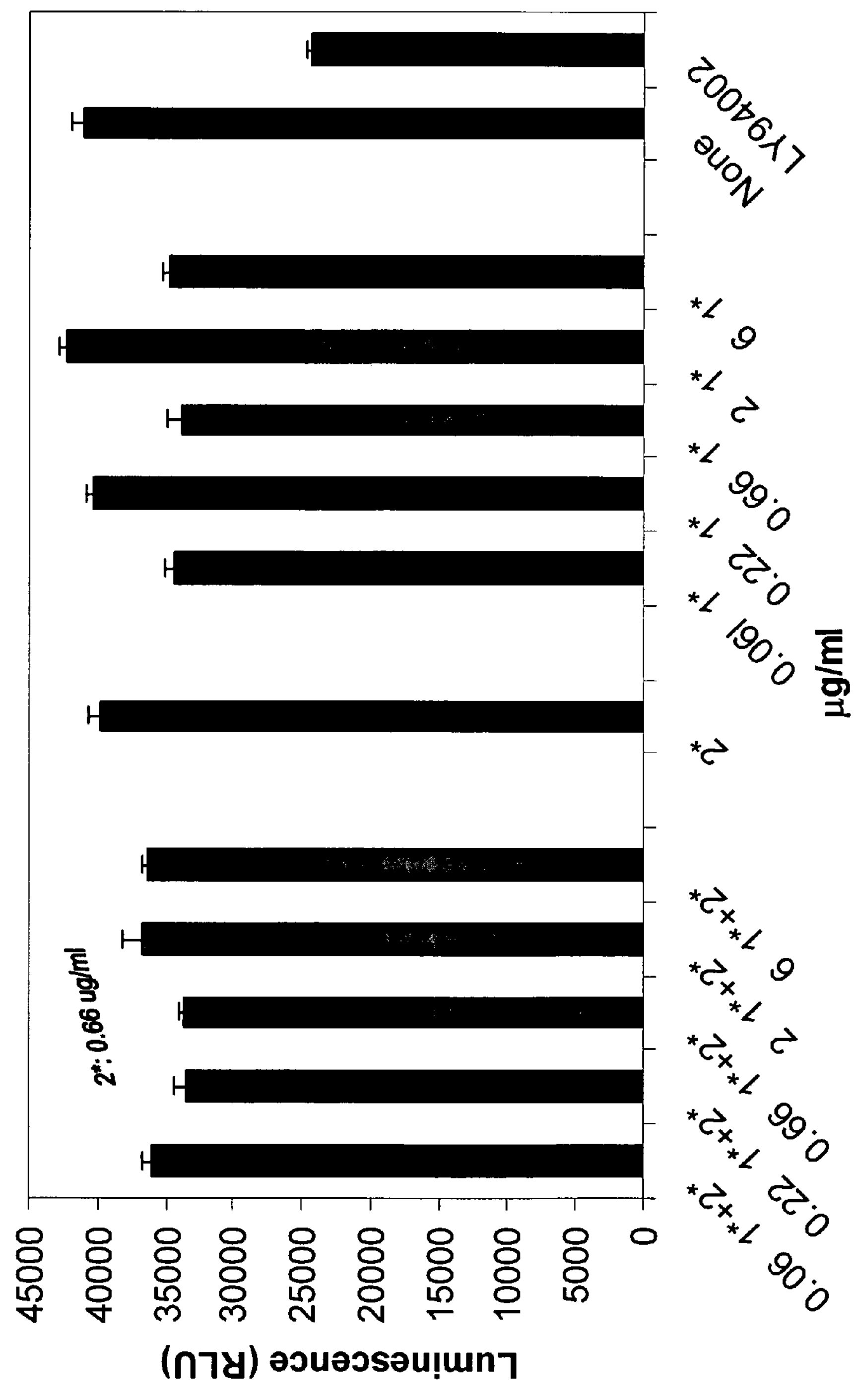

FIG. 56. Saporin-Conjugated 2nd Ab+CD166 mAb Does Not Induce Cell Death in CD166 Negative HCC1937 Breast Cells.

Figure 57:
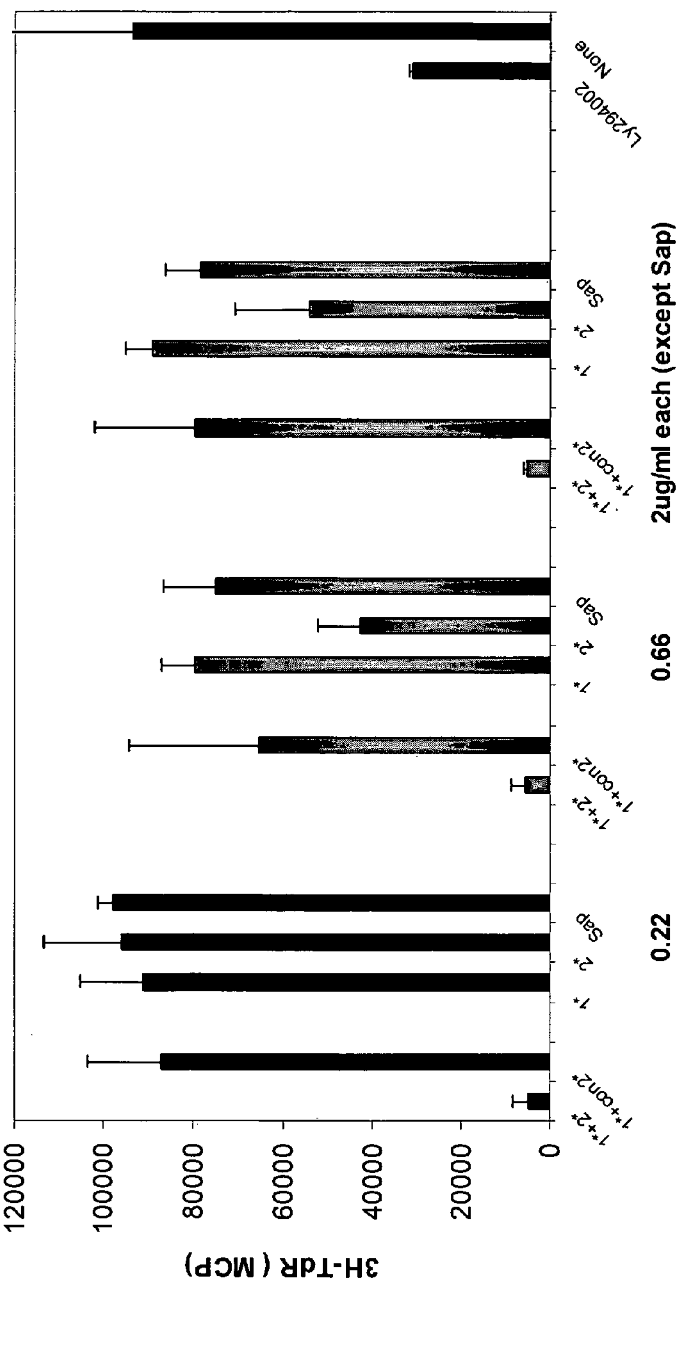

FIG. 57. Saporin-Conjugated 2nd Ab+CD166 mAb Induces Cell Death in CD166 Positive HCC1954 Breast Cells.

Figure 58:
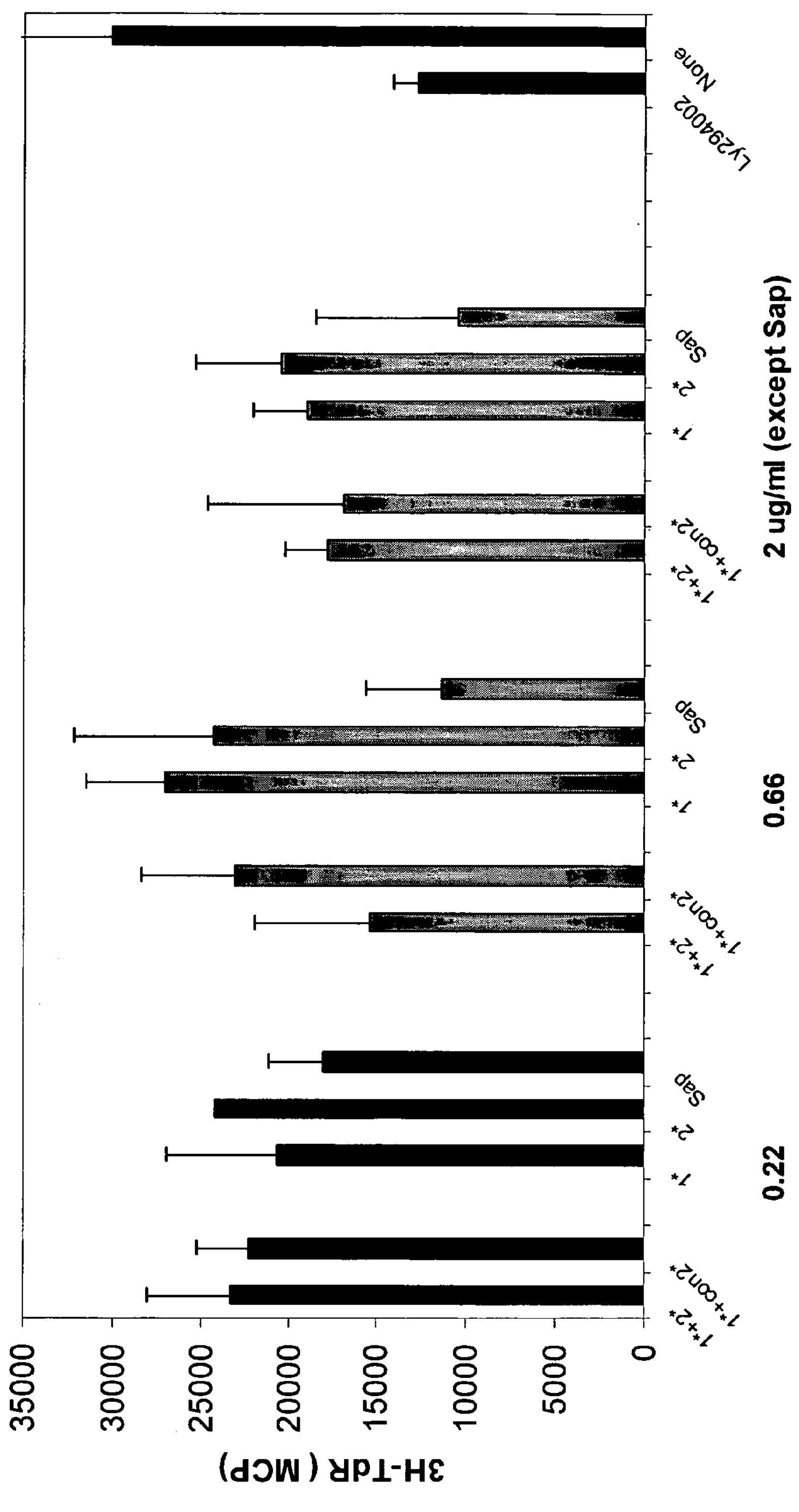

FIG. 58. Saporin-Conjugated 2nd Ab+CD166 mAb Does Not Induce Cell Death in CD166 Negative HCC1937 Breast Cells.

Figure 59:
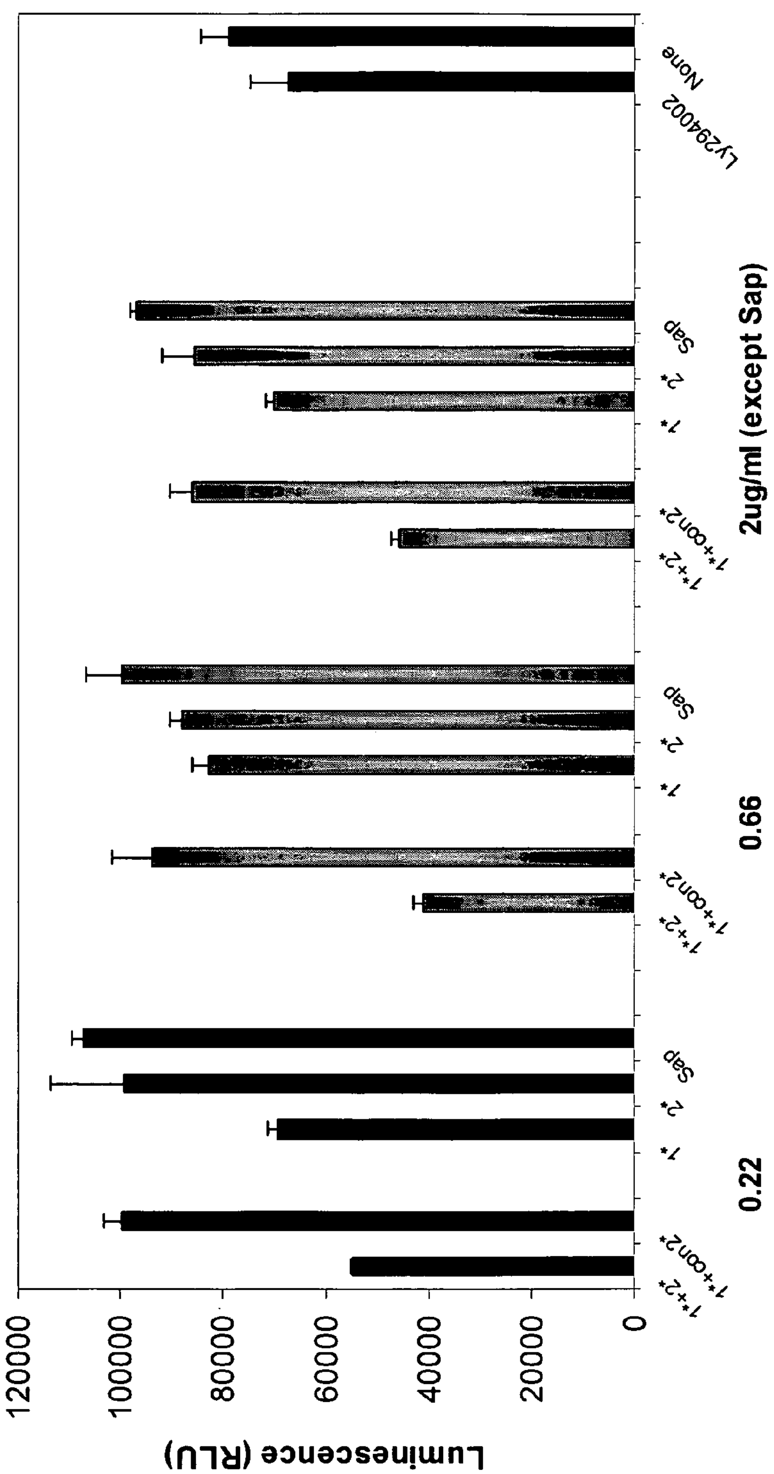

FIG. 59. Saporin-Conjugated 2nd Ab+CD166 mAb Induces Cell Death in CD166 Positive HCC1954 Breast Cells.

Figure 60:
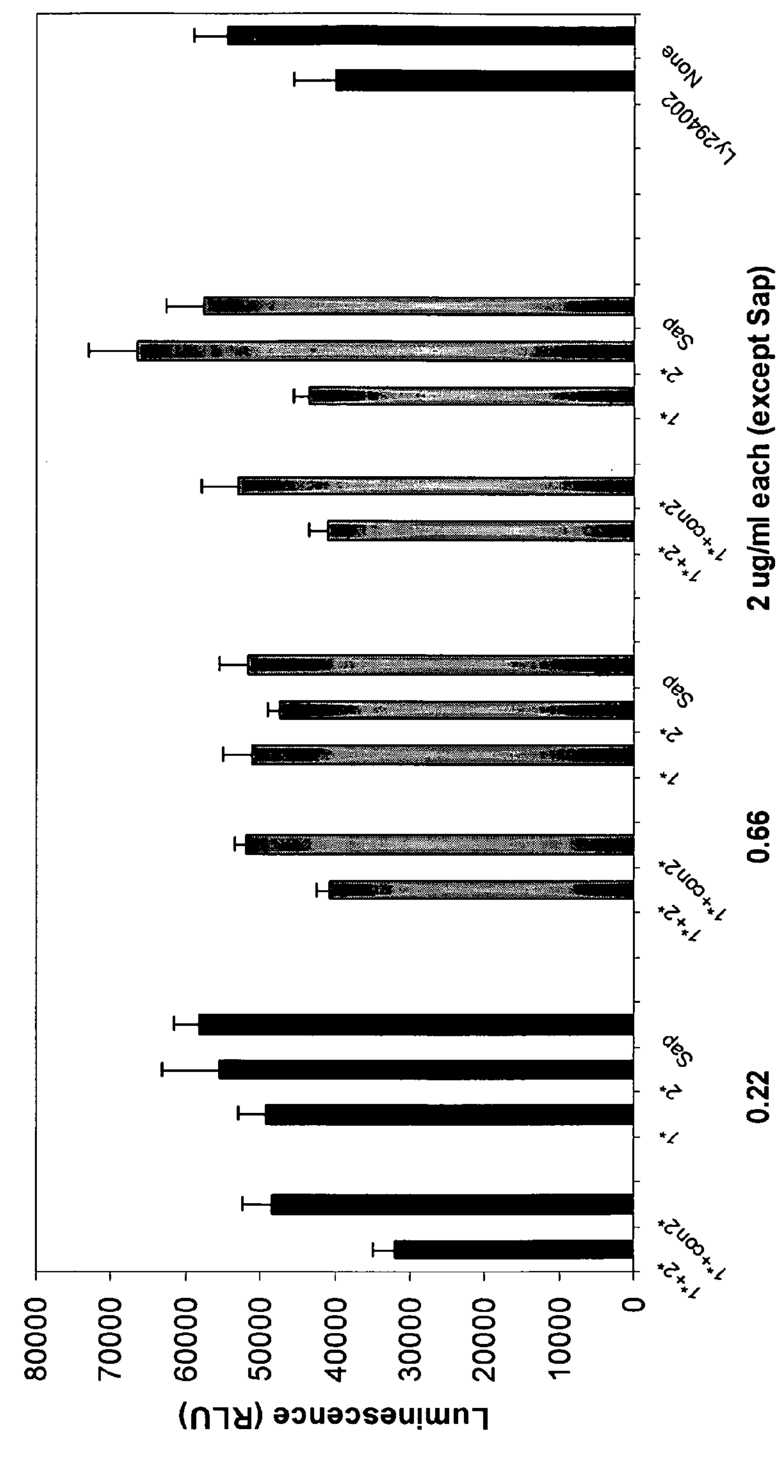

FIG. 60. Saporin-Conjugated 2nd Ab+CD166 mAb Does Not Induce Cell Death in CD166 Negative HCC1937 Breast Cells.

FIG. 61. mRNA Sequence of CD166 (ALCAM), indicating siRNA target regions.

CD55

FIG. 62. CD55 is Over-expressed in Multiple Tumor Types.

Figure 63:
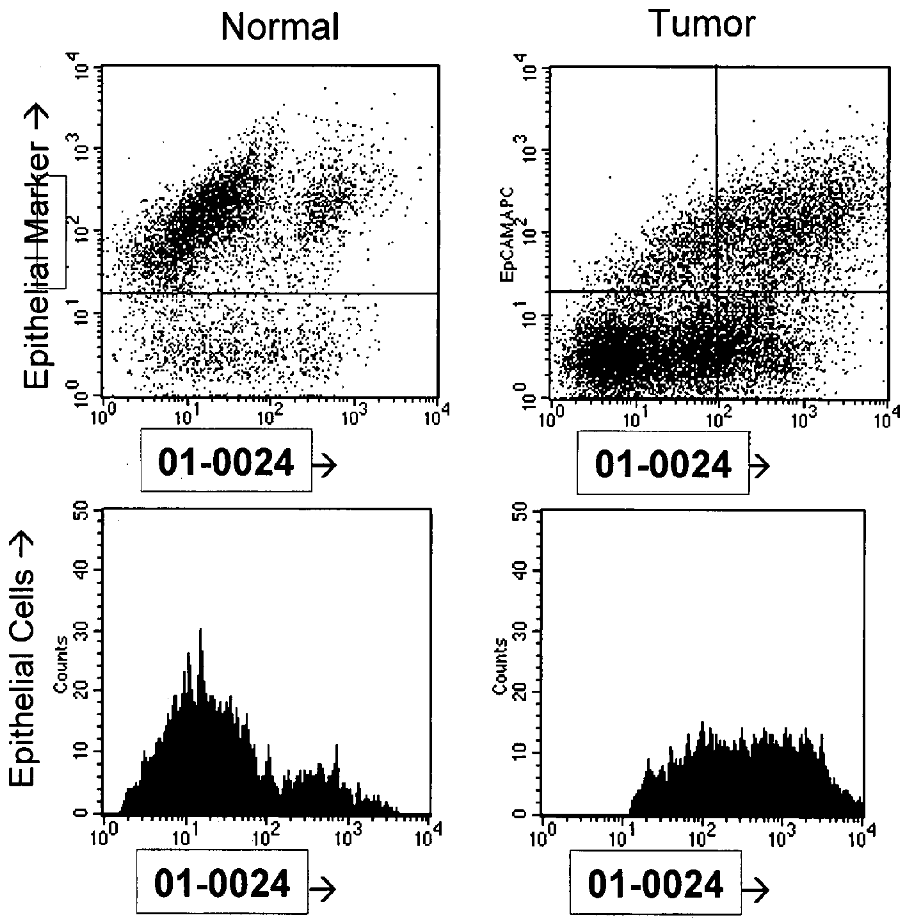

FIG. 63. QFACS Confirms Over-Expression of CD55 on the Surface of Colon Tumors.

Figure 64:
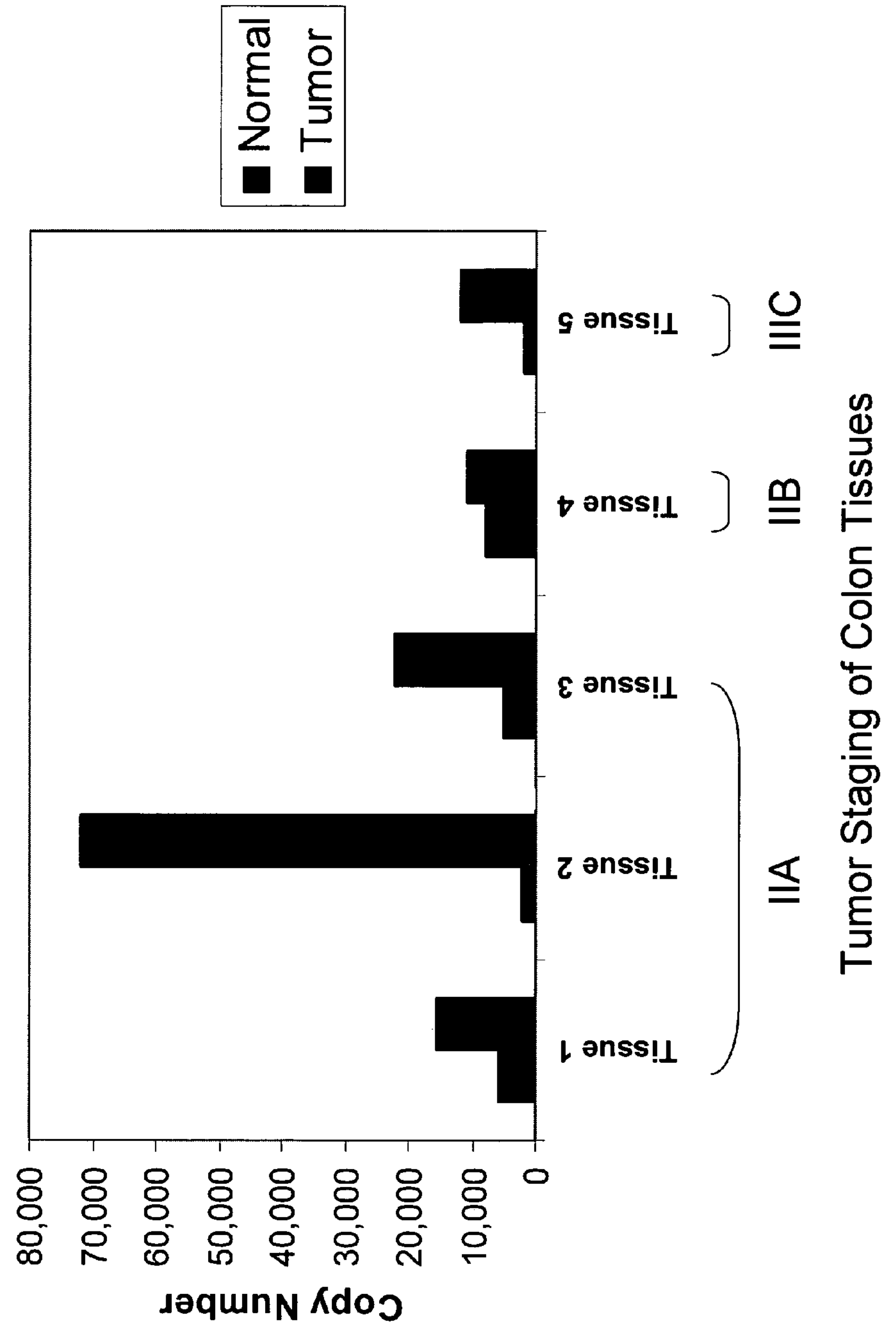

FIG. 64. QFACS Analysis Confirms that CD55 is Differentially Expressed in Colon Tumor Tissues.

Figure 65:
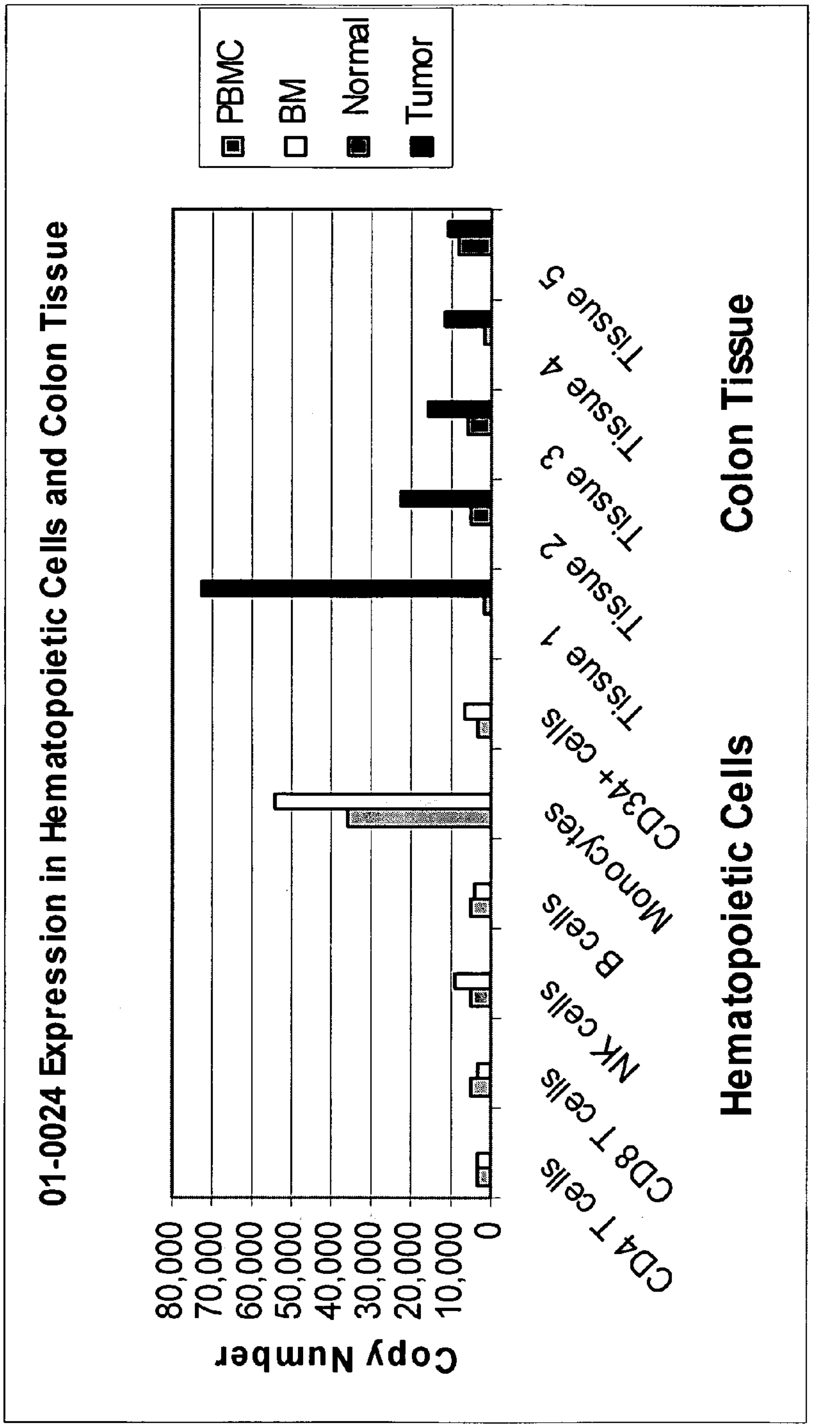

FIG. 65. CD55 Expression Analysis by QFACS—Hematopoietic Cells vs. Colon Tissue.

Figure 66:
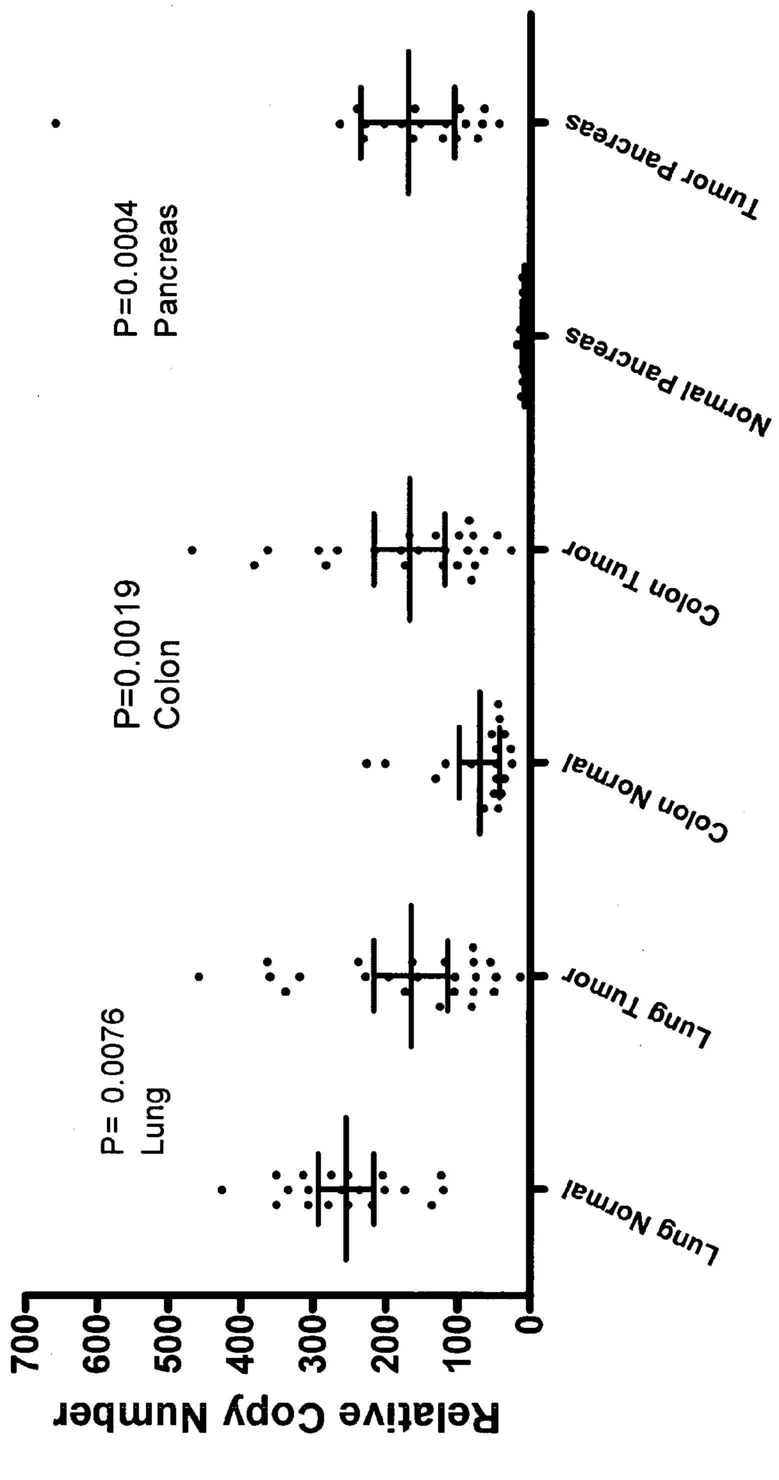

FIG. 66. CD55 mRNA Expression Analysis in Tumor Tissues.

Figure 67:
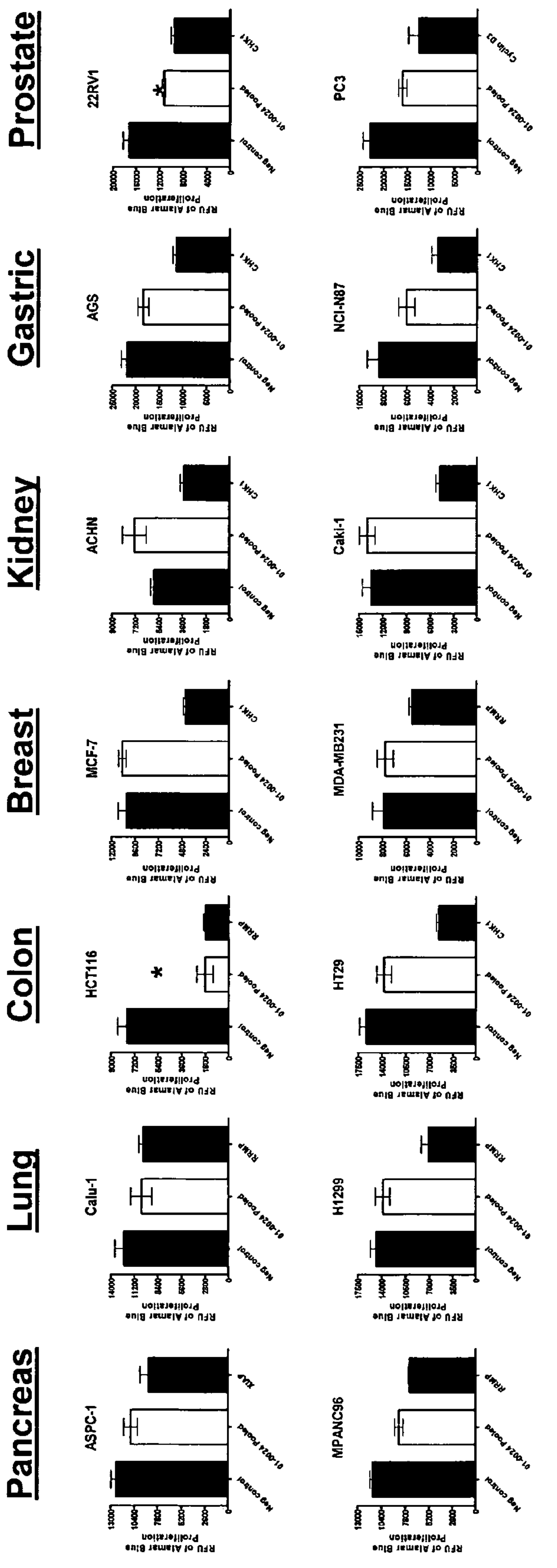

FIG. 67. Knockdown of CD55 mRNA Inhibits Proliferation in Colon and Prostate Cancer Cells.

Figure 68:
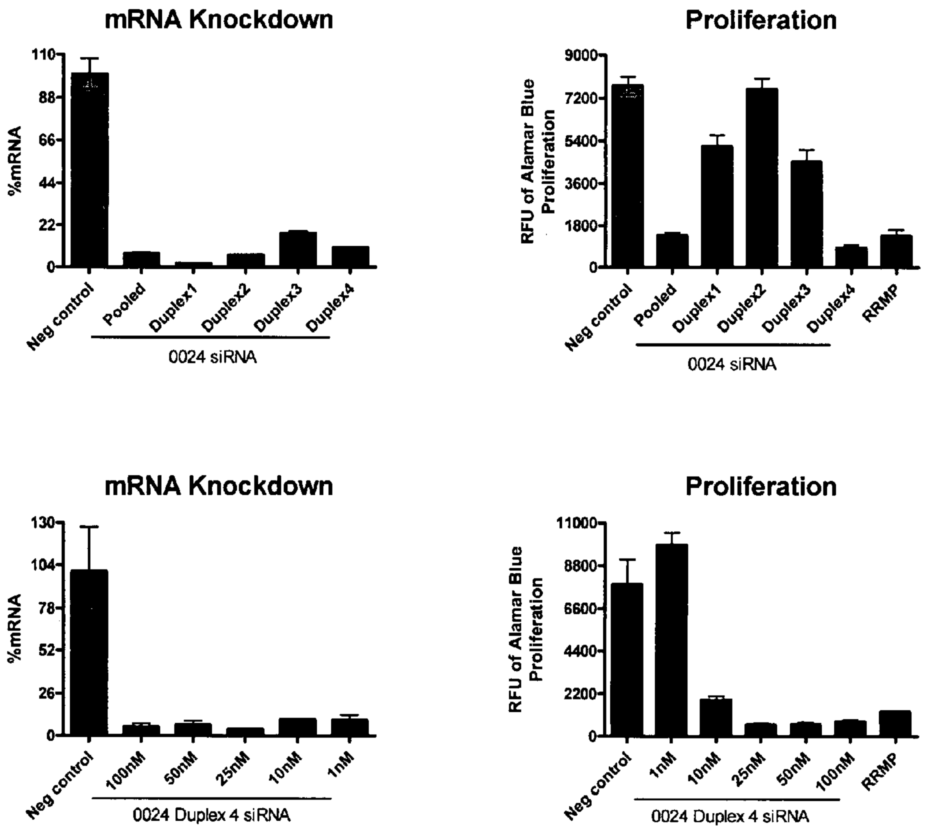

FIG. 68. Knockdown of CD55 mRNA Inhibits Proliferation in HCT116 Colon Cancer Cells.

Figure 69:
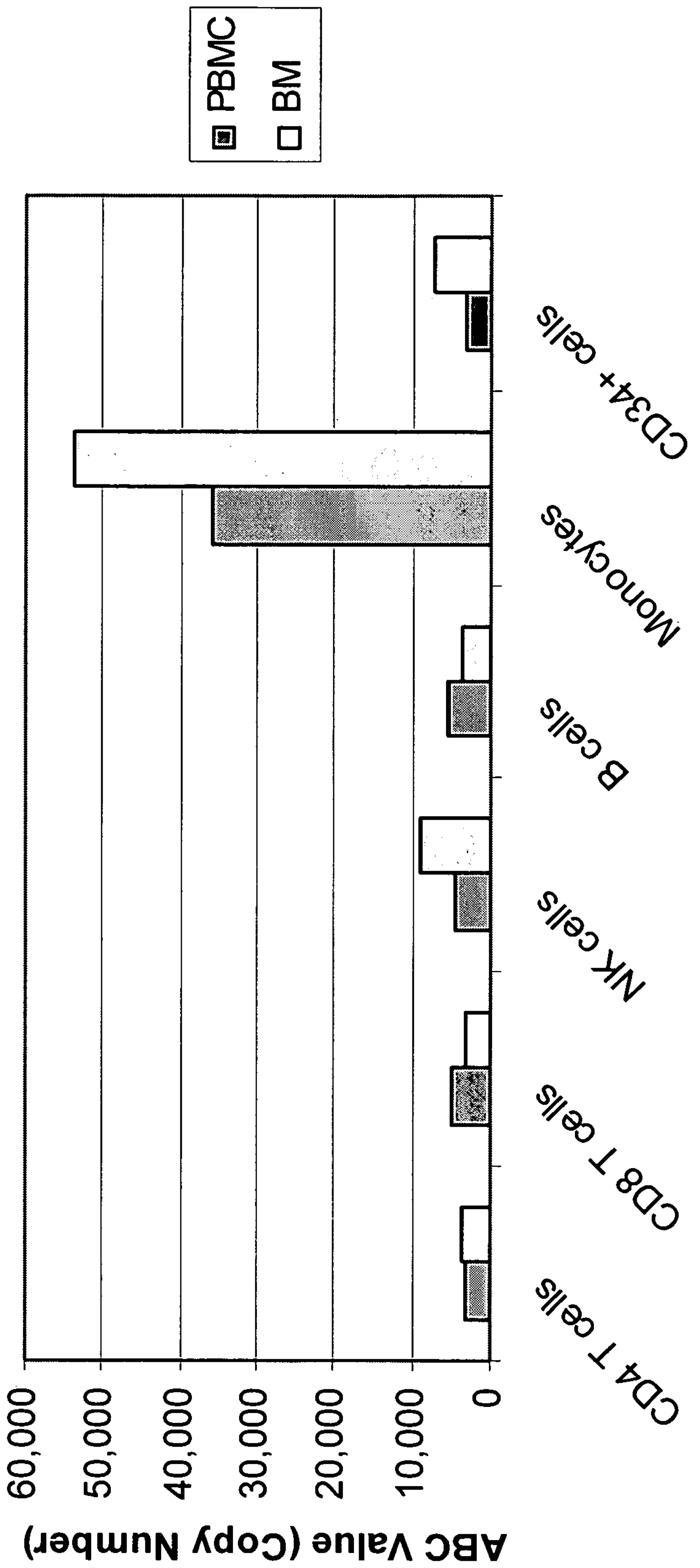

FIG. 69. CD55 Expression in PBMC and Bone Marrow.

Figure 70:
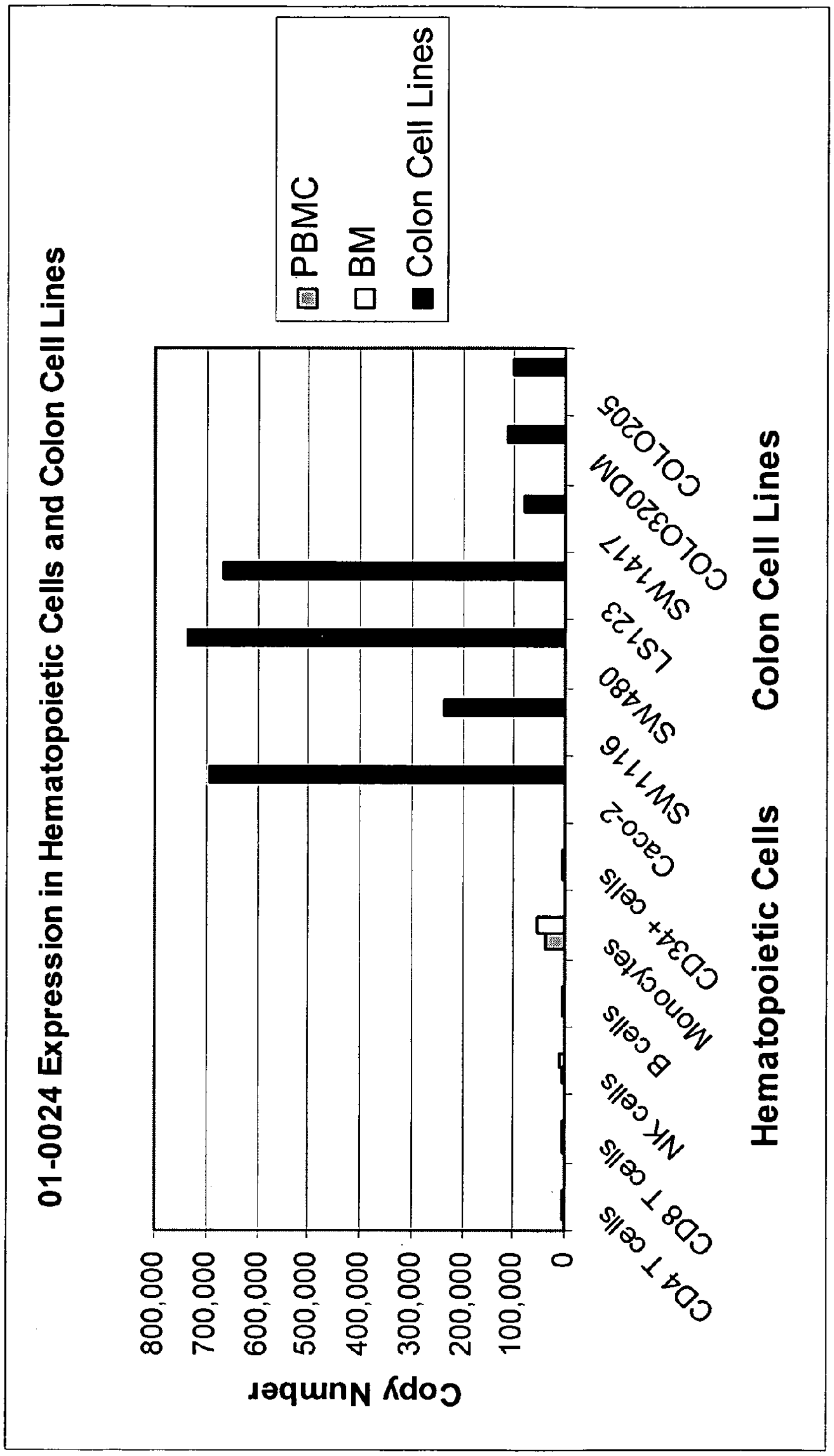

FIG. 70. CD55 Expression Analysis by QFACS—Hematopoietic Cells vs. Colon Cell Lines.

Figure 71:
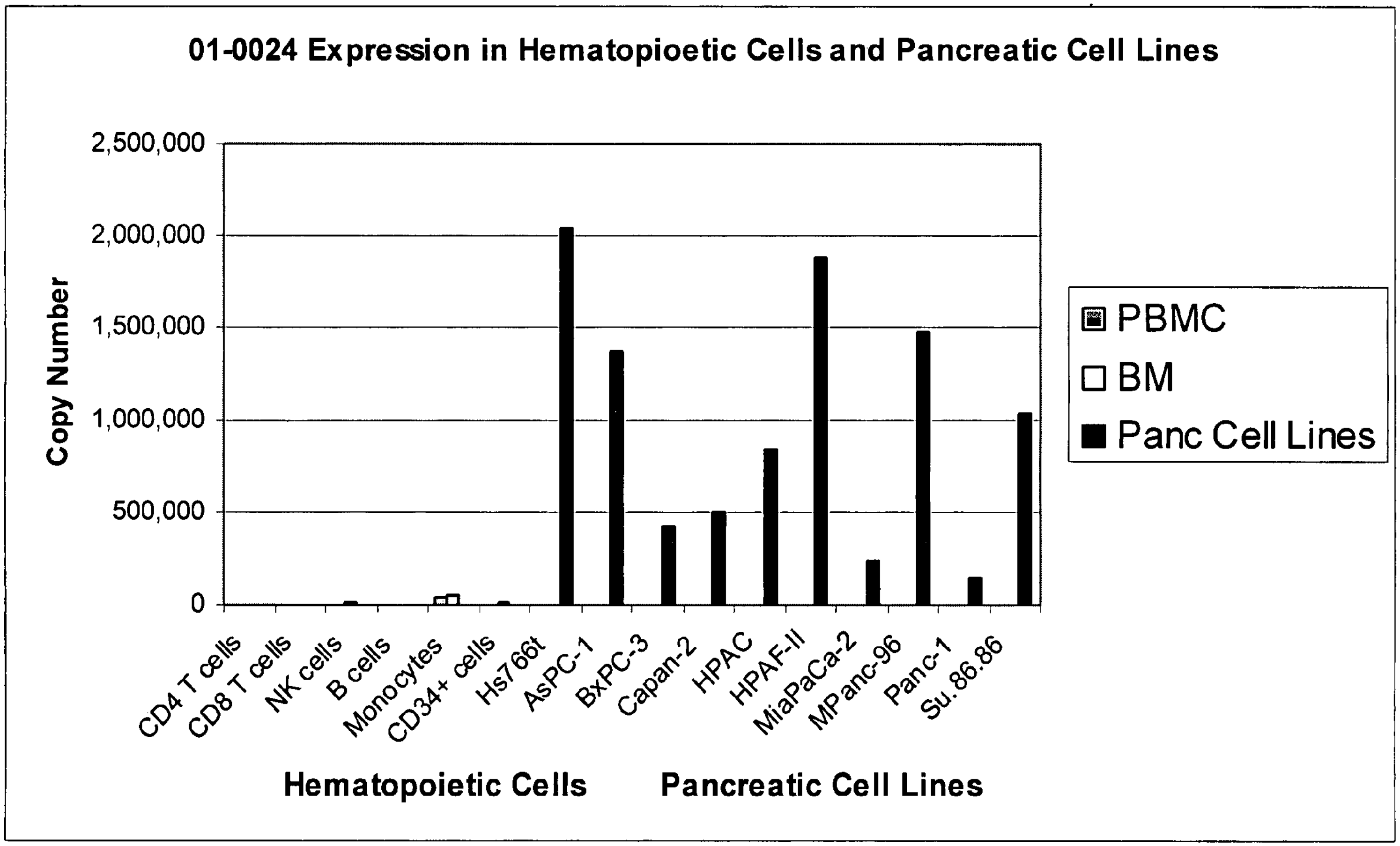

FIG. 71. CD55 Expression Analysis by QFACS—Hematopoietic Cells vs. Pancreatic Cell Lines.

Figure 72:

FIG. 72. CD55 Expression in Hematopoietic Cells.

Figure 73:
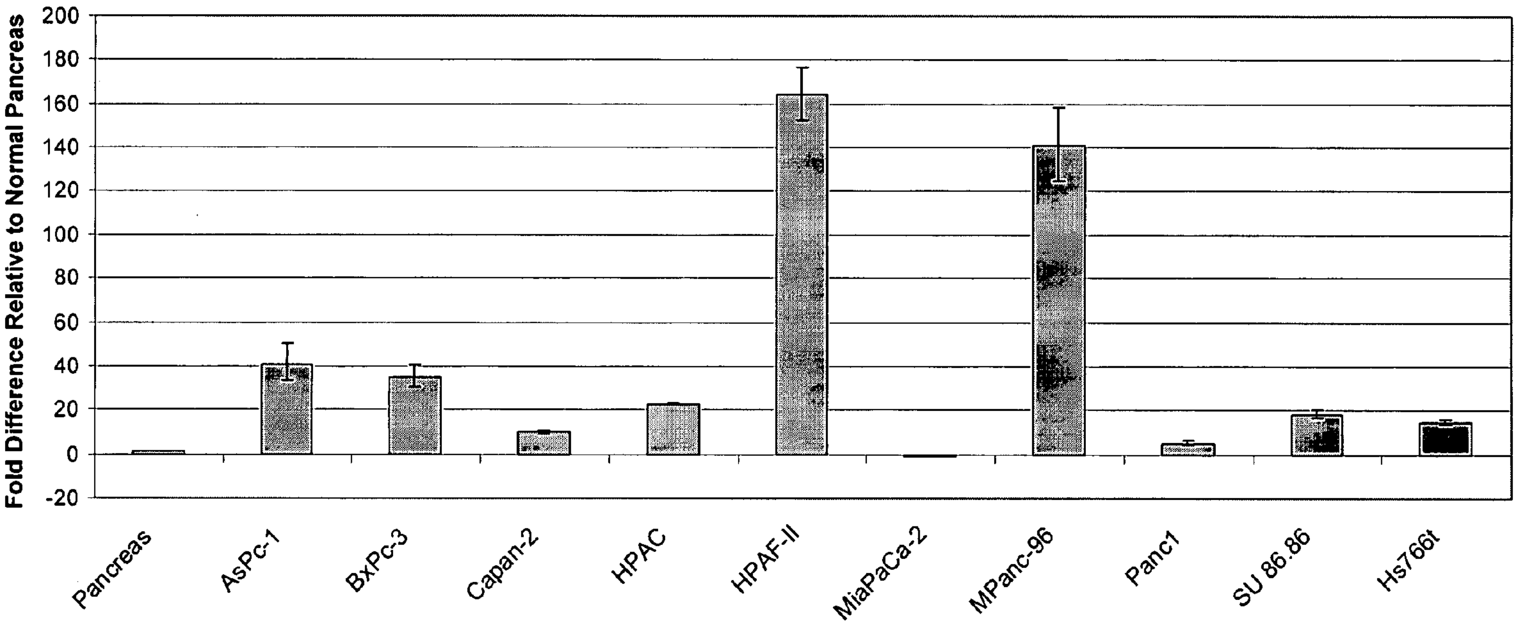

FIG. 73. CD55 mRNA Overexpression—Pancreas Cell Line Panel.

Figure 74:
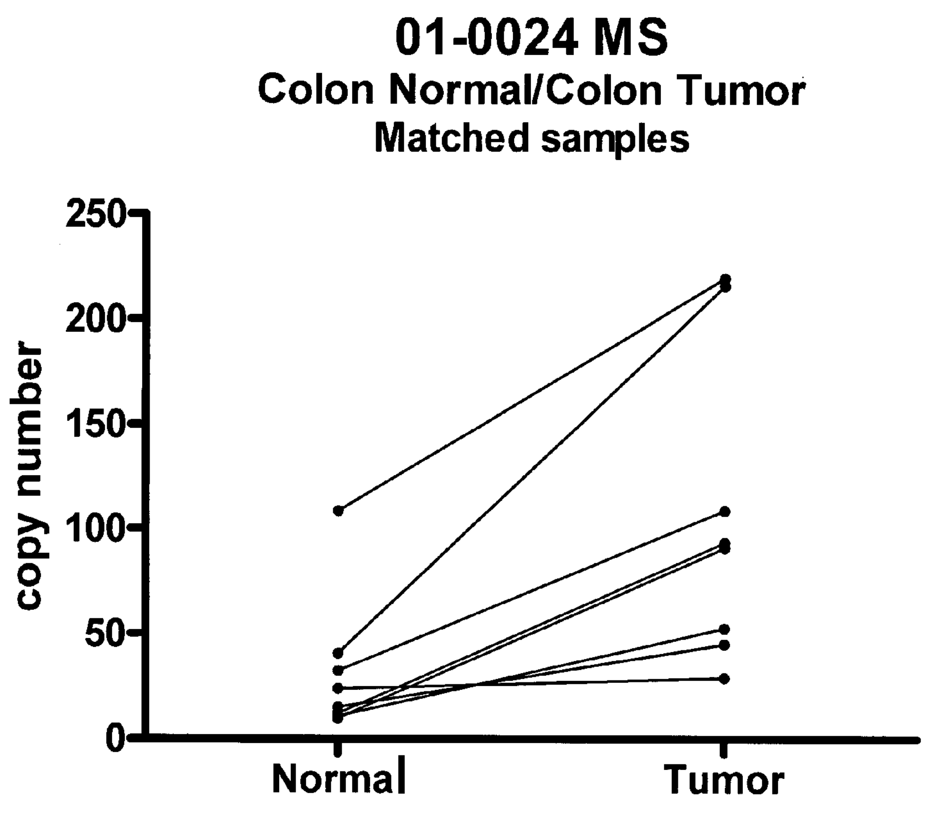

FIG. 74. CD55 mRNA is Overexpressed in Colon Tumor Tissue.

Figure 75:
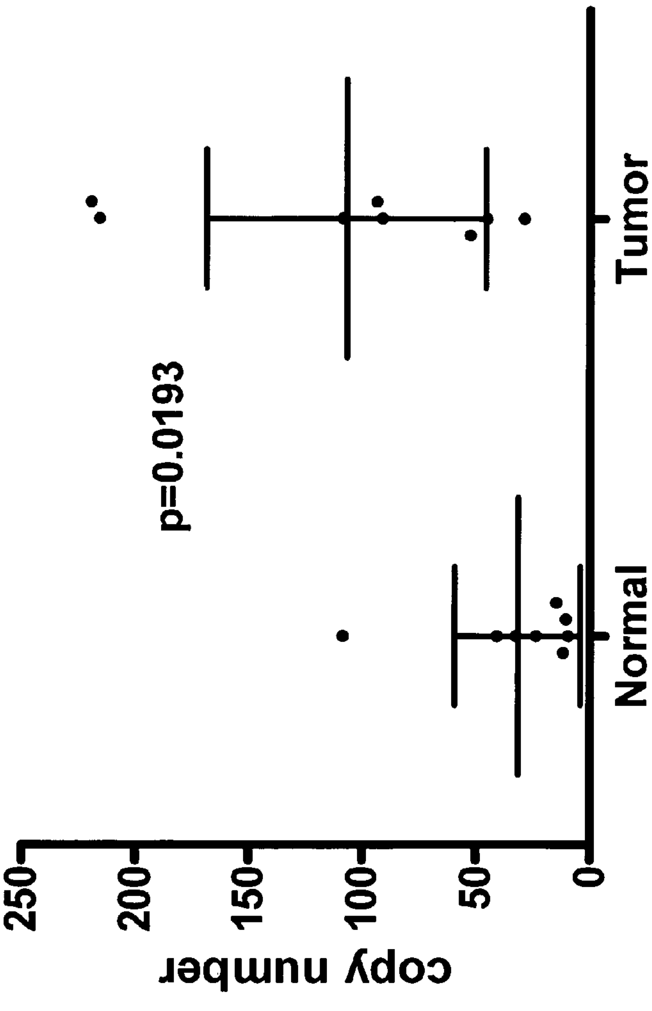

FIG. 75. CD55 mRNA is Overexpressed in Colon Tumor Tissue.

Figure 76:
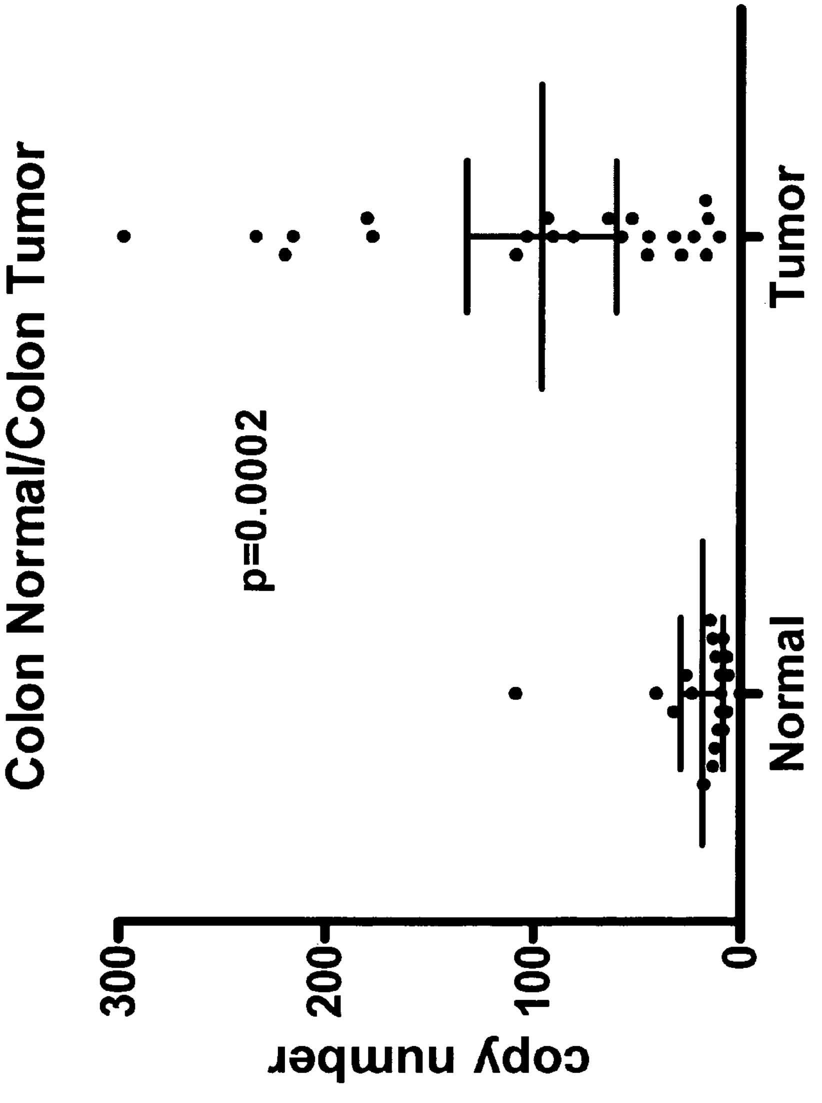

FIG. 76. CD55 mRNA is Overexpressed in Colon Tumor Tissue.

Figure 77:
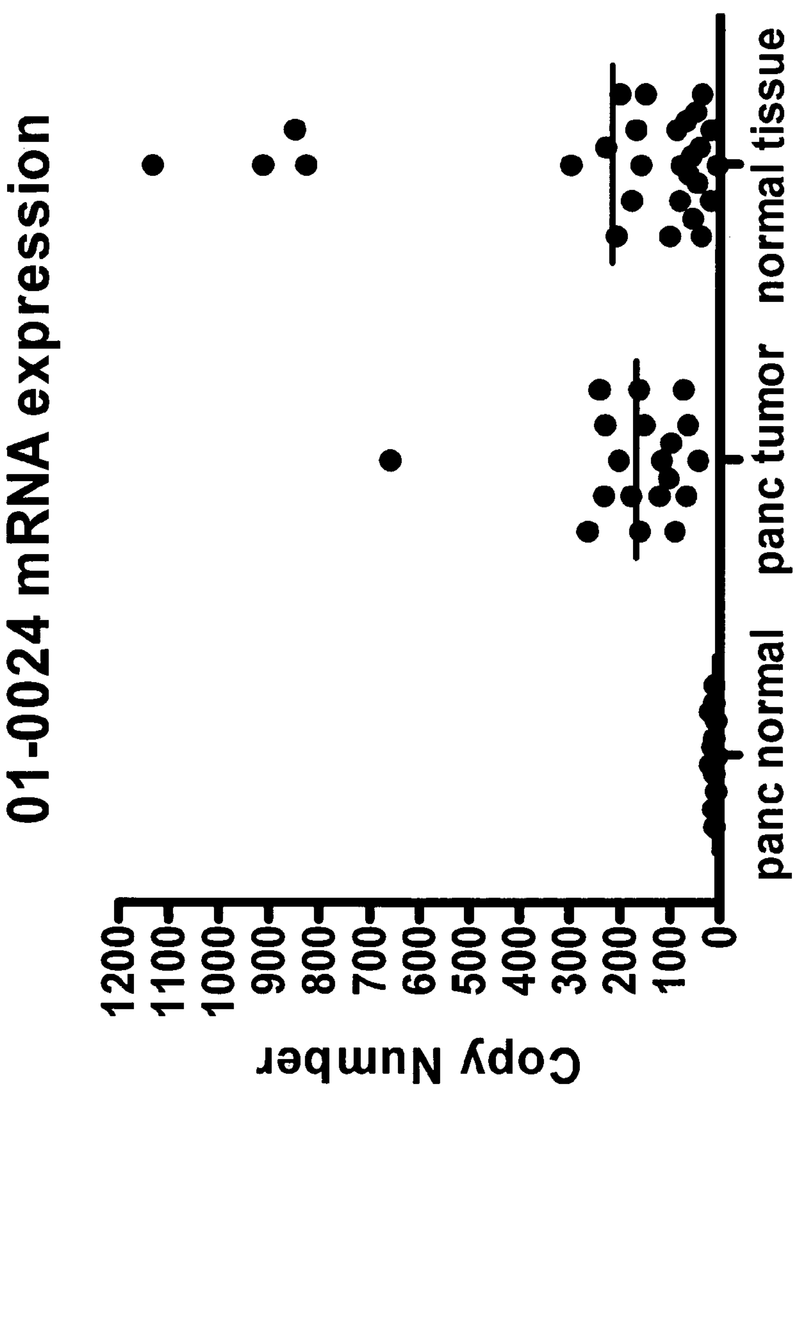

FIG. 77. CD55 mRNA Expression in Pancreatic Tumor Tissues.

Figure 78:
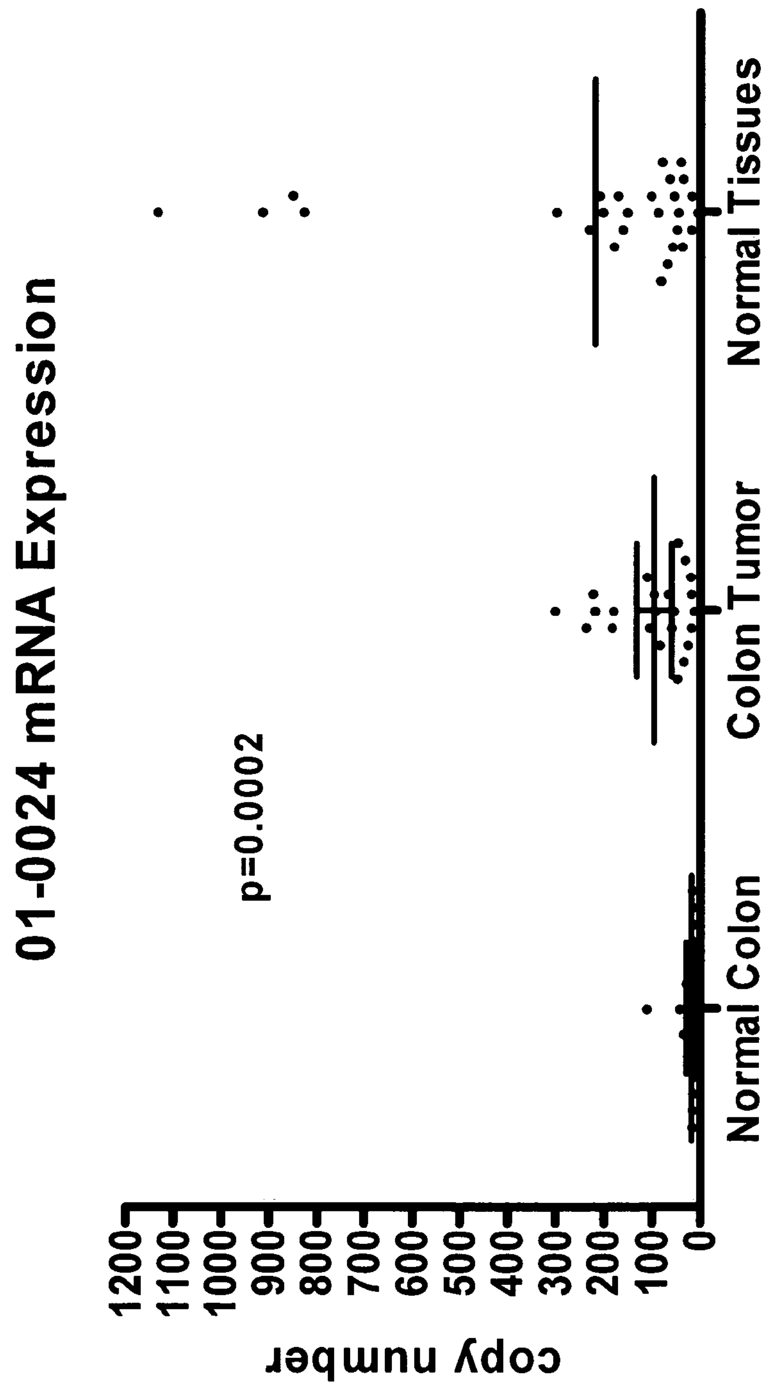

FIG. 78. CD55 mRNA Expression in Colon Tumor Tissues.

FIG. 79. CD55 qFACS Data Summary.

FIG. 80. CD55 qFACS Data Summary.

FIG. 81. CD55 is Over-expressed in Multiple Tumor Types.

FIG. 82. mRNA sequence of CD55, indicating siRNA target regions.

TG2

FIG. 83. TG2 is Over-Expressed in Multiple Tumor Types.

Figure 84:
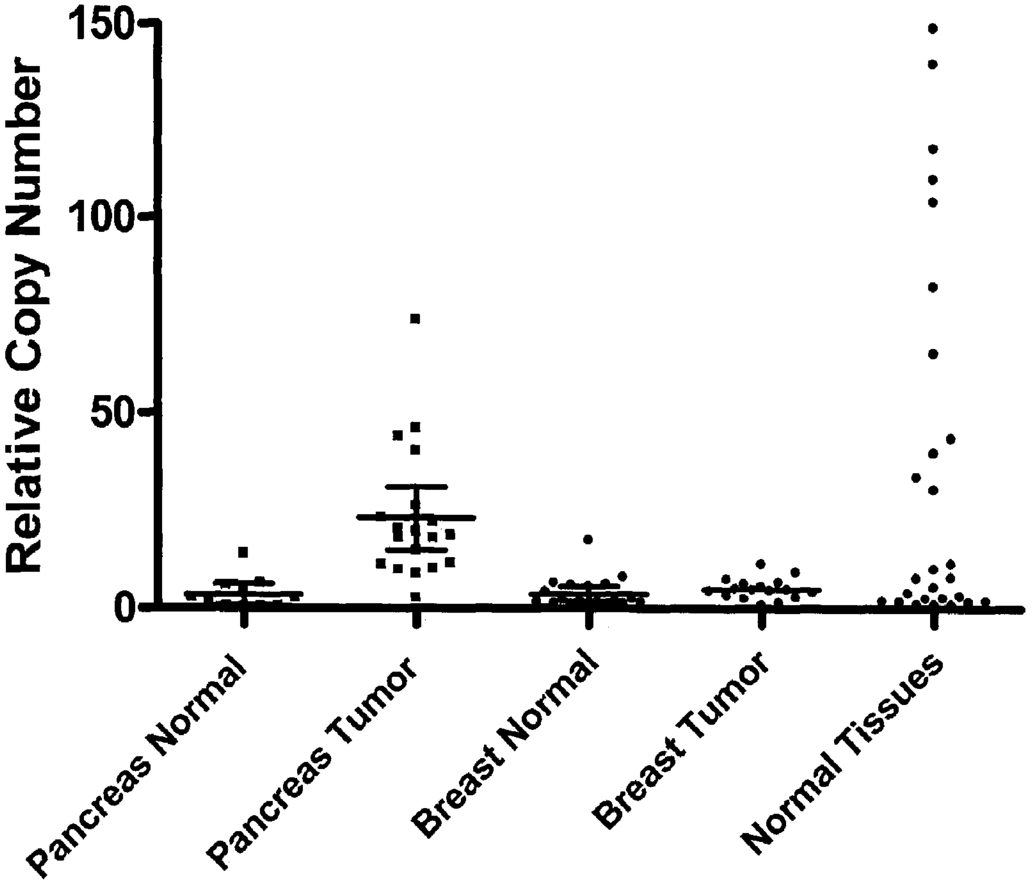

FIG. 84. TG2 mRNA Expression Analysis in Multiple Tumor Tissues.

Figure 85:
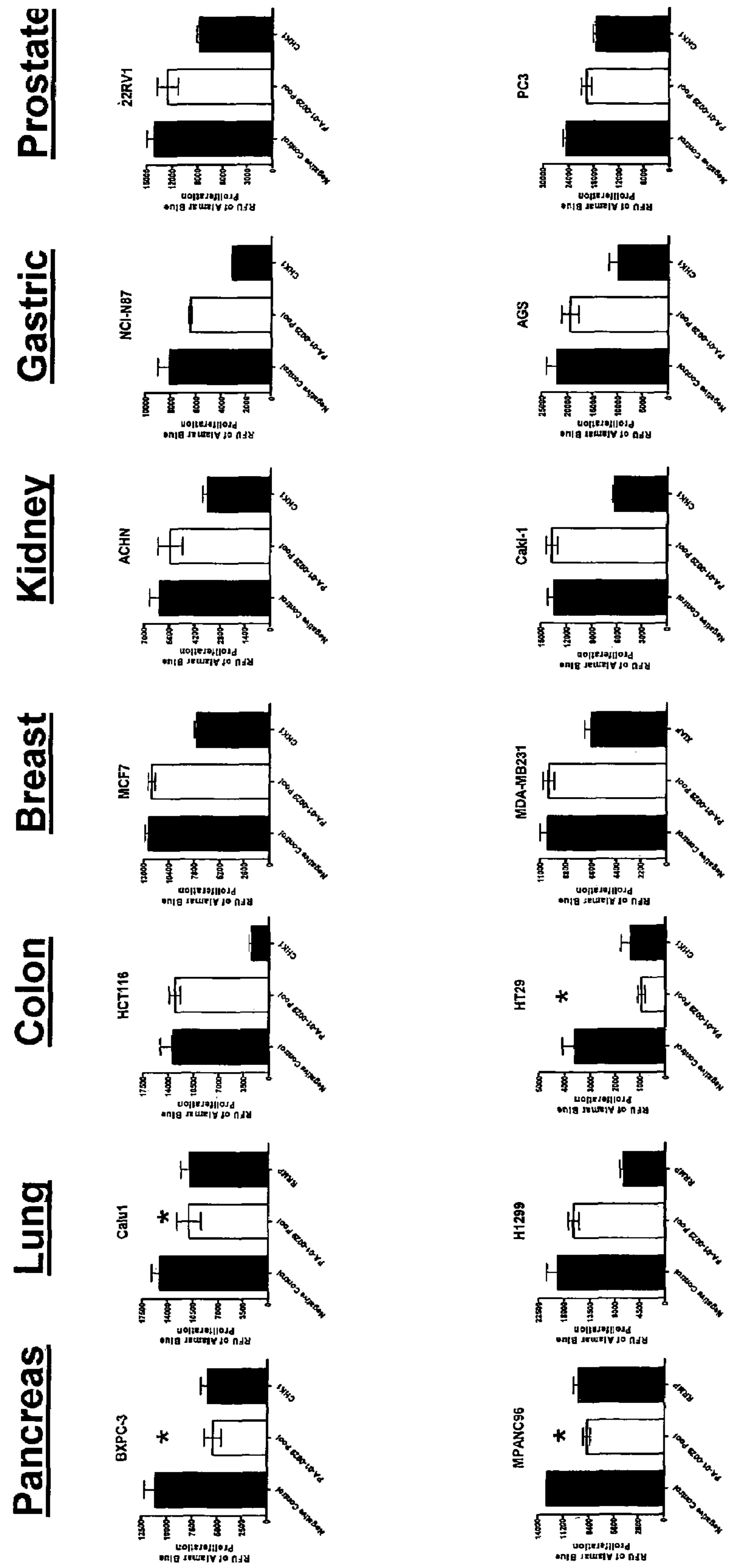

FIG. 85. Knockdown of TG2 mRNA Inhibits Proliferation in Pancreas, Lung and Colon Cancer Cells.

Figure 86:
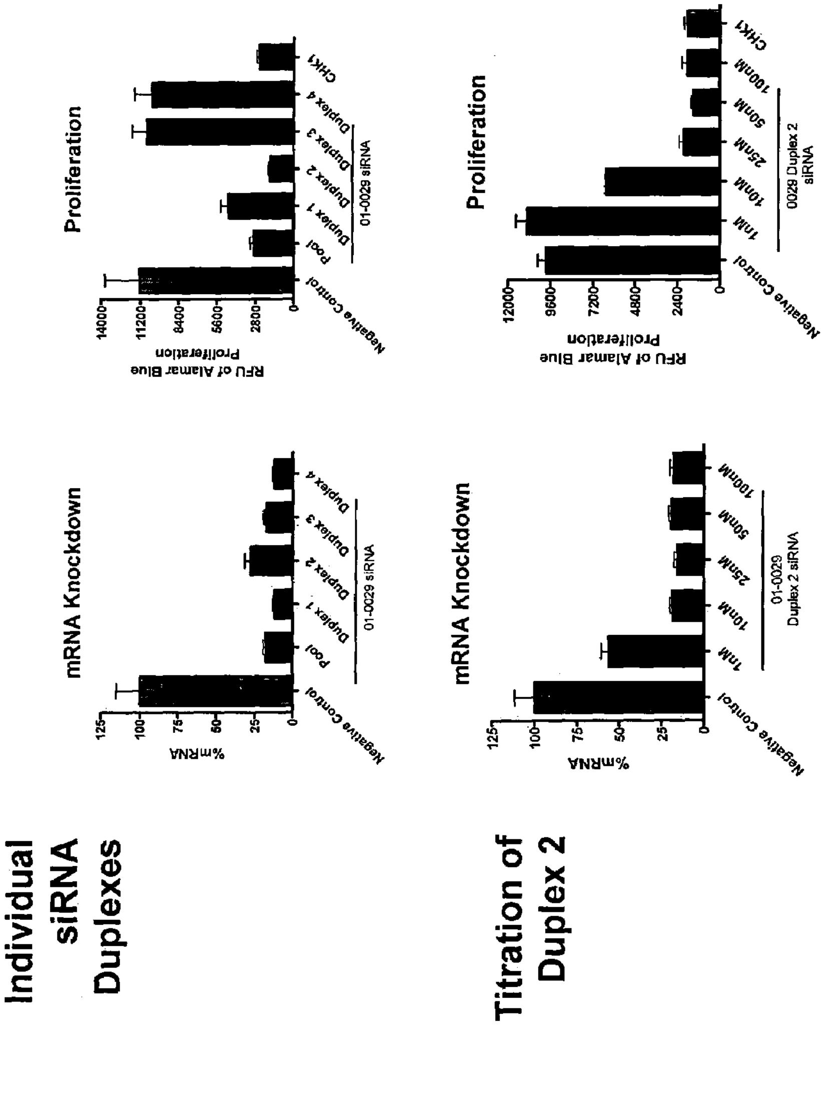

FIG. 86. Knockdown of TG2 mRNA Inhibits Proliferation in HT29 Colon Cells.

Figure 87:
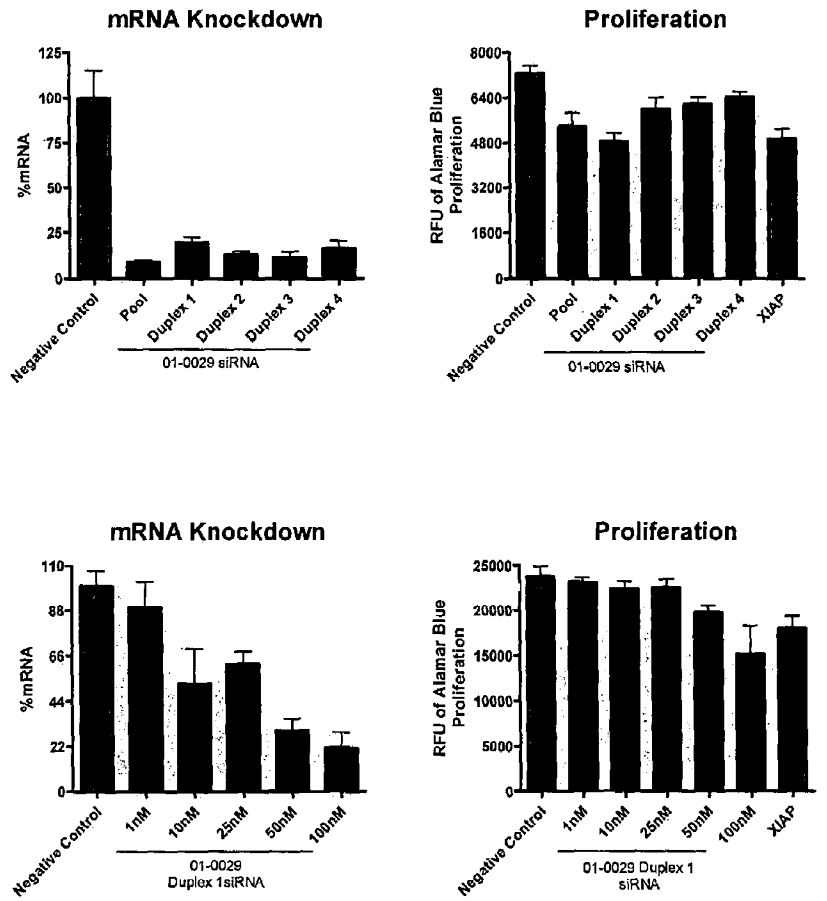

FIG. 87. Knockdown of TG2 mRNA Inhibits Proliferation in Calu1 Lung Cells.

Figure 88:
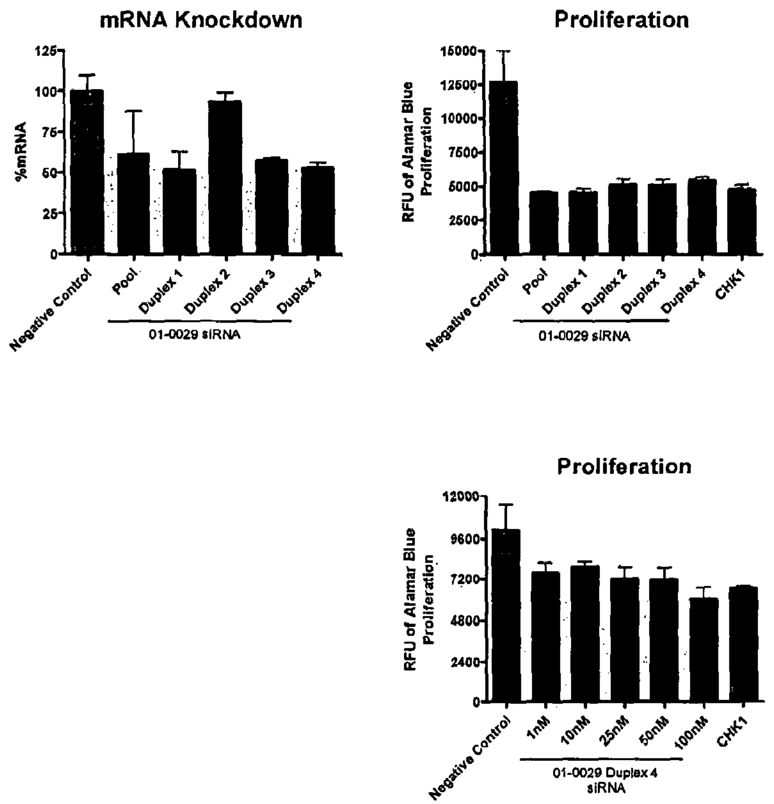

FIG. 88. Knockdown of TG2 mRNA Inhibits Proliferation in BXPC-3 Pancreas Cells.

FIG. 89. mRNA sequence of TG2, indicating siRNA target regions.

CD49f

FIG. 90. CD49f is Over-Expressed in Multiple Tumor Types by IHC.

Figure 91:
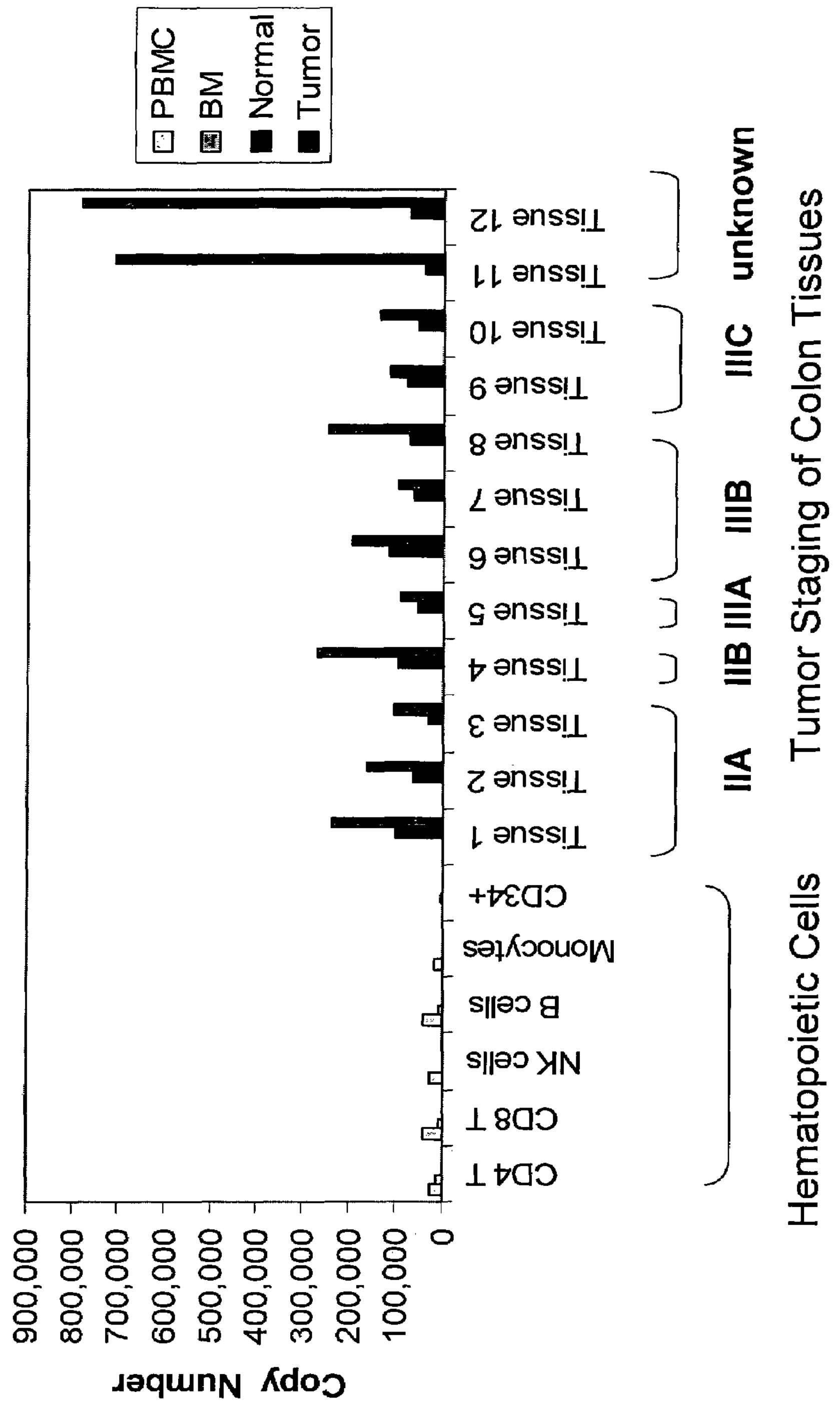

FIG. 91. CD49f is Over-expressed in Colon Tumors Relative to PBMC and Bone Marrow.

Figure 92:
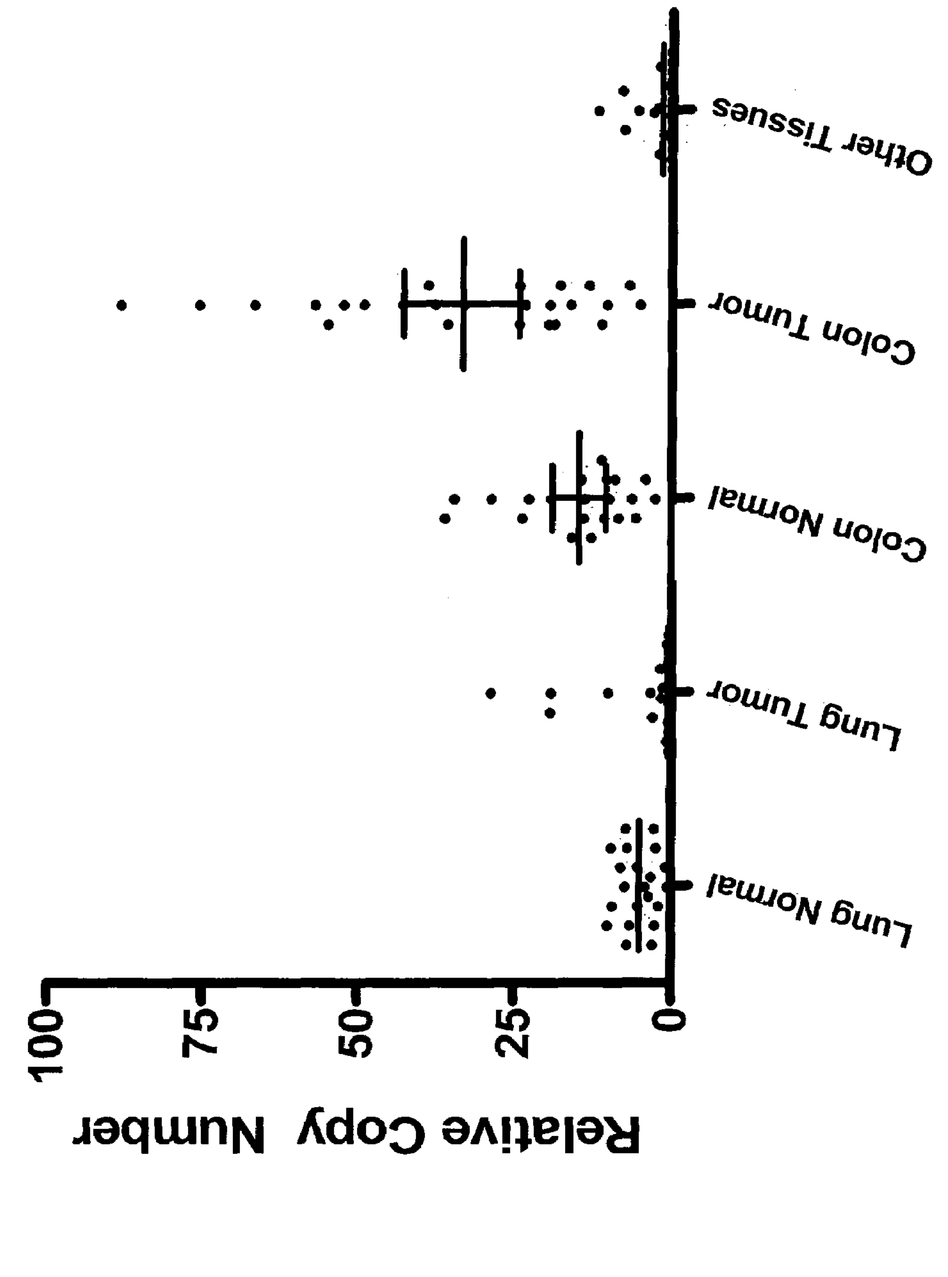

FIG. 92. CD49f mRNA Expression Analysis in Tumor Tissues.

Figure 93:
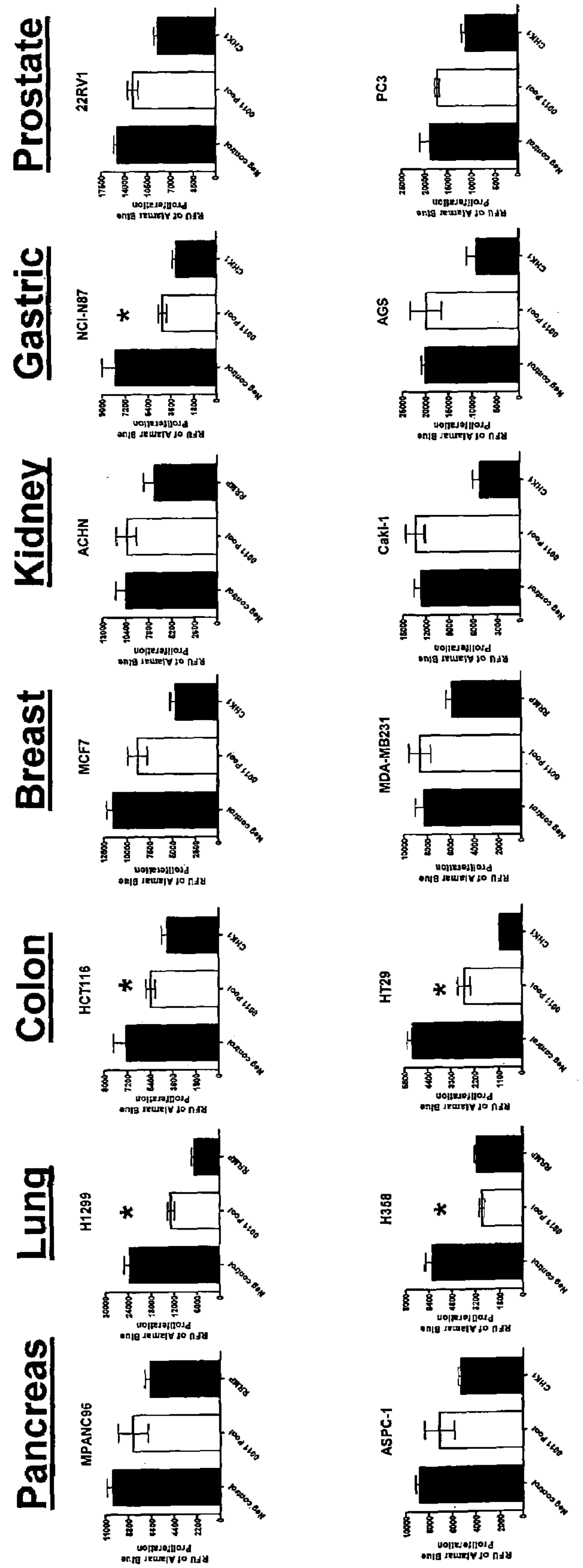

FIG. 93. Knockdown of CD49f mRNA Inhibits Proliferation in Lung, Colon and Gastric Cancer Cells.

Figure 94:
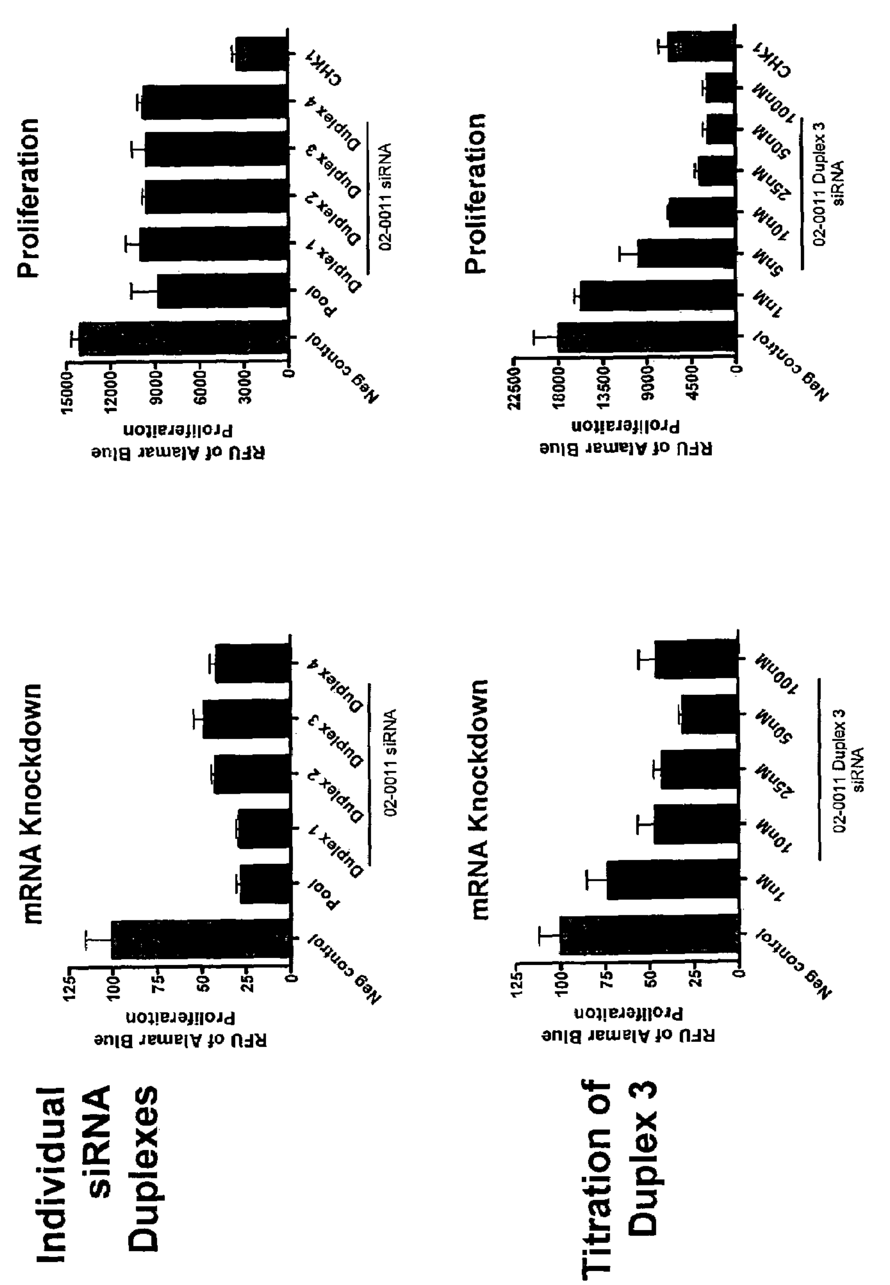

FIG. 94. Knockdown of CD49f mRNA Inhibits Proliferation in HT29 Colon Cancer Cells.

Figure 95:
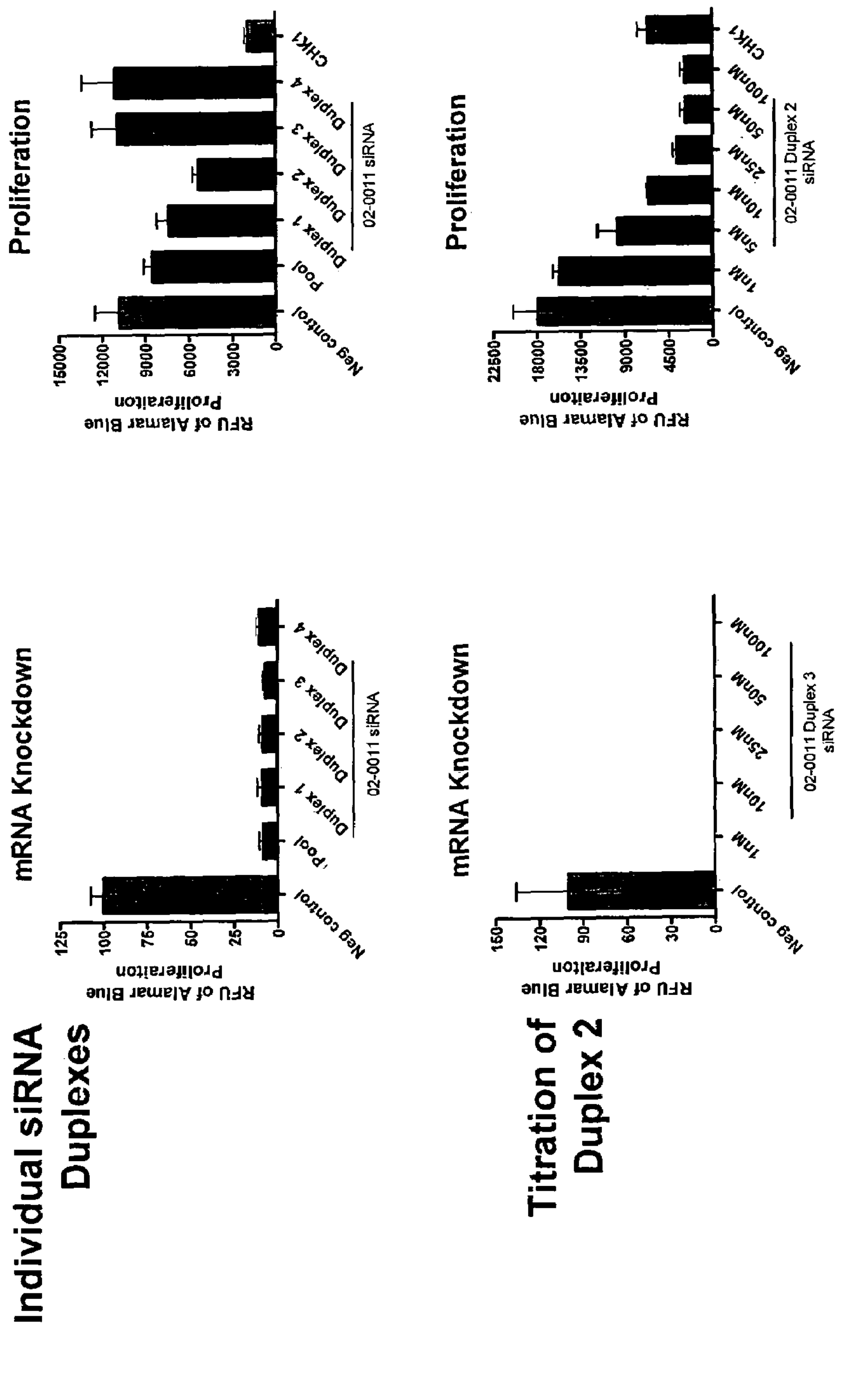

FIG. 95. Knockdown of CD49f mRNA Inhibits Proliferation in HCT116 Colon Cancer Cells.

FIG. 96. Knockdown of CD49f mRNA Inhibits Proliferation in NCI-N87 Gastric Cancer Cells.

Figure 97:
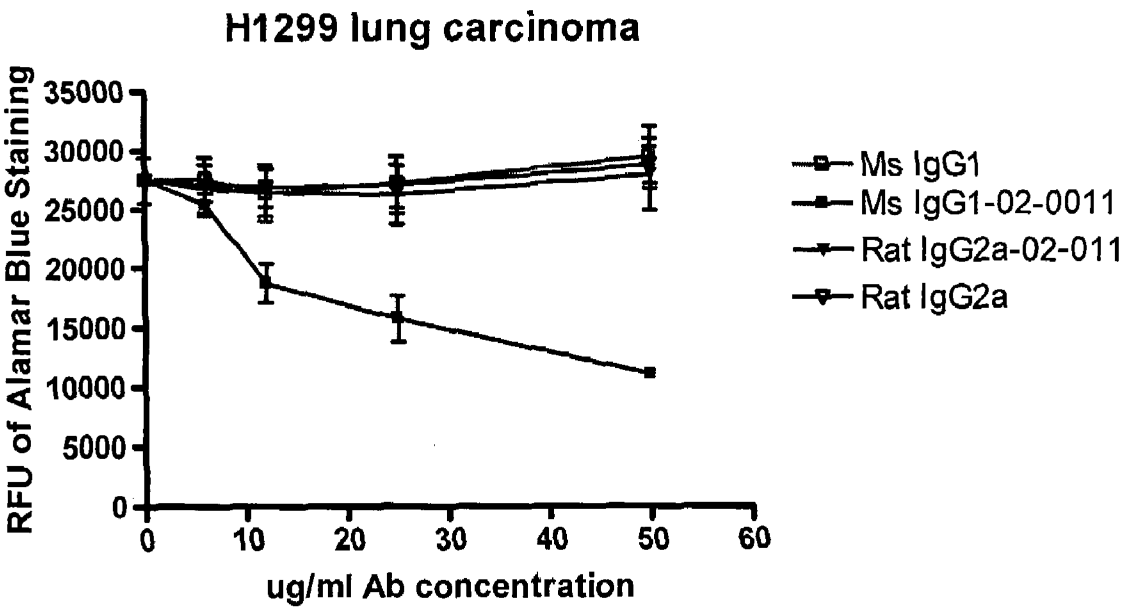

FIG. 97. Anti-CD49f Antibody blocked H1299 Lung Tumor Cell Line Proliferation.

FIG. 98. mRNA Sequence of CD49f, indicating siRNA target regions.

CD98

FIG. 99. CD98 is Over-expressed in Multiple Tumor Types.

Figure 100:
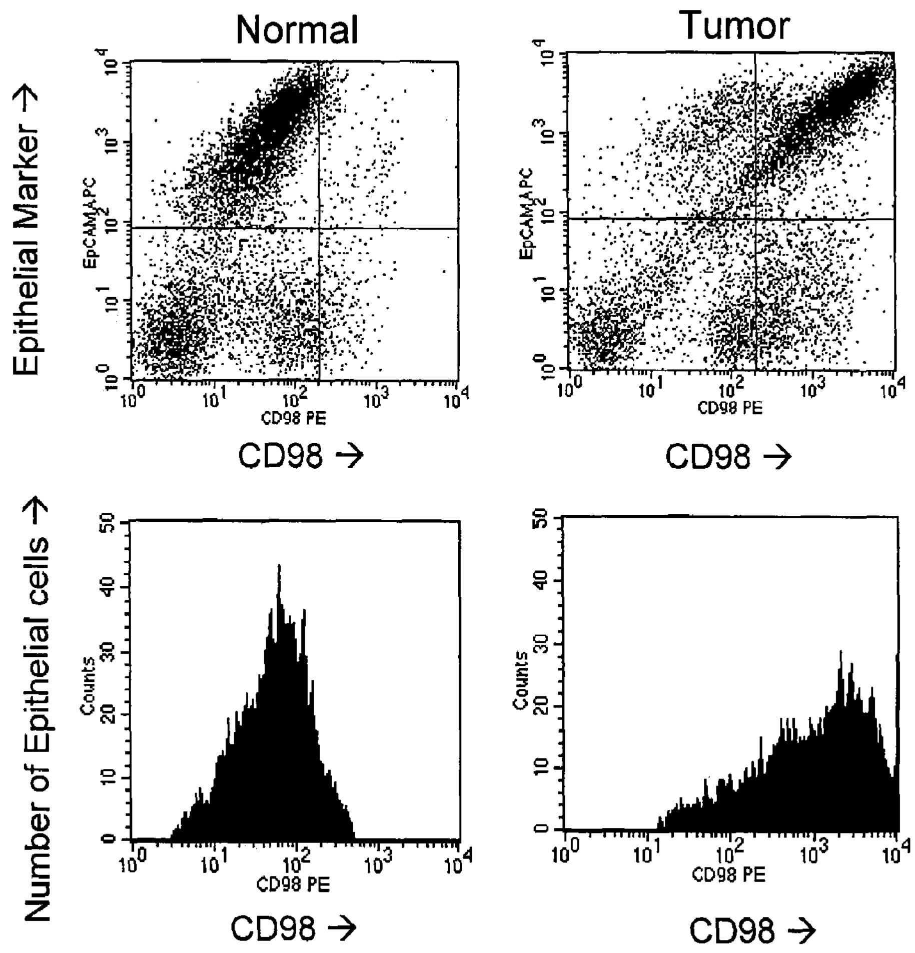

FIG. 100. CD98 is Over-expressed in Colon Tumors.

Figure 101:
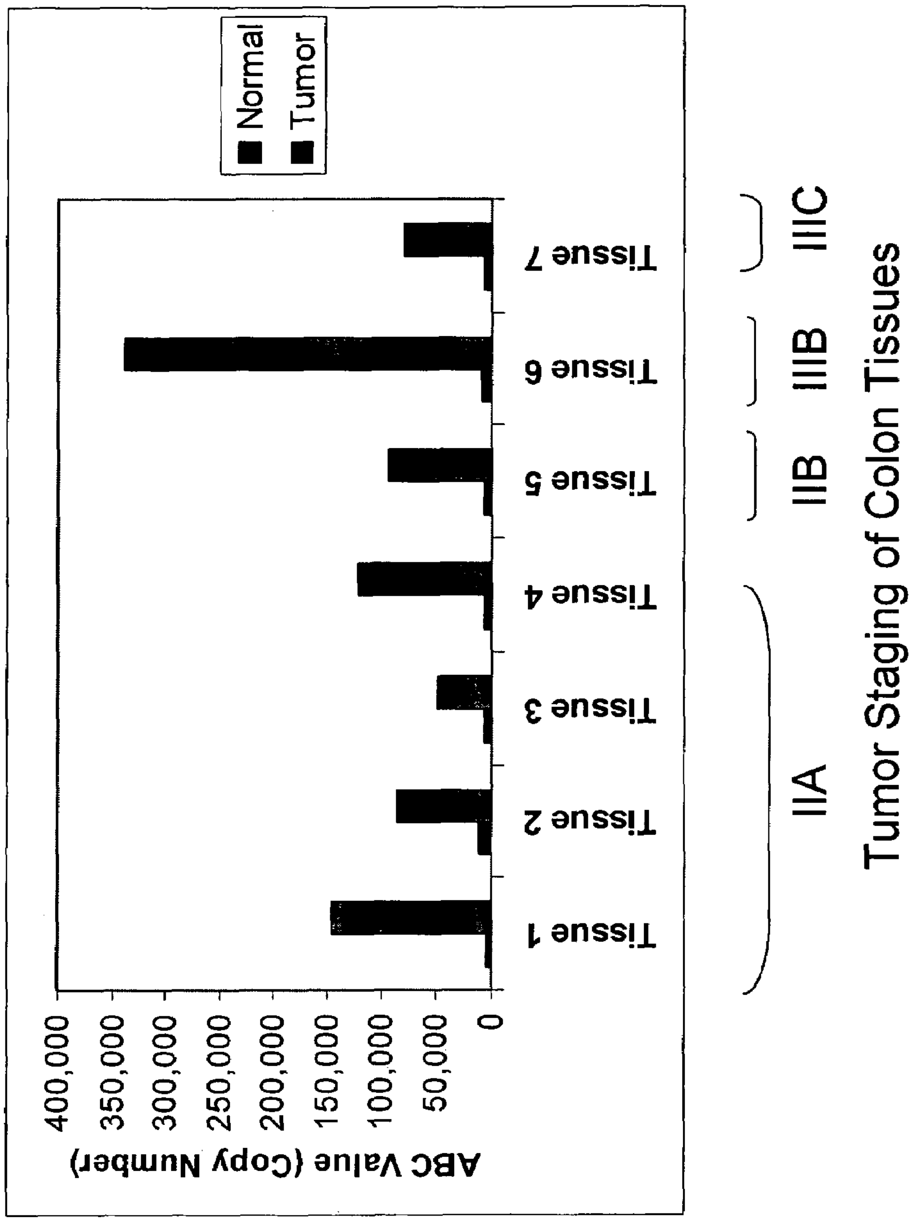

FIG. 101. CD98 is Over-expression in Colorectal Tumors by QFACS.

Figure 102:
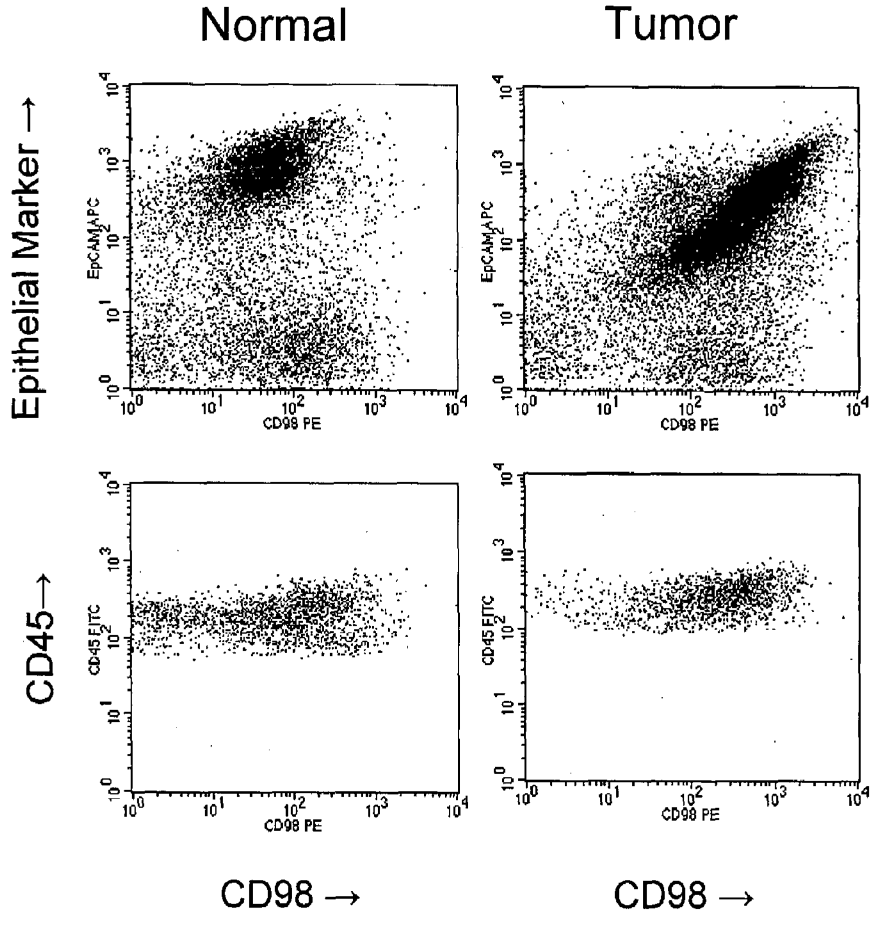

FIG. 102. CD98 is Over-expressed in Colon Tumors Relative to Normal Colon and CD45+ Cells.

Figure 103:
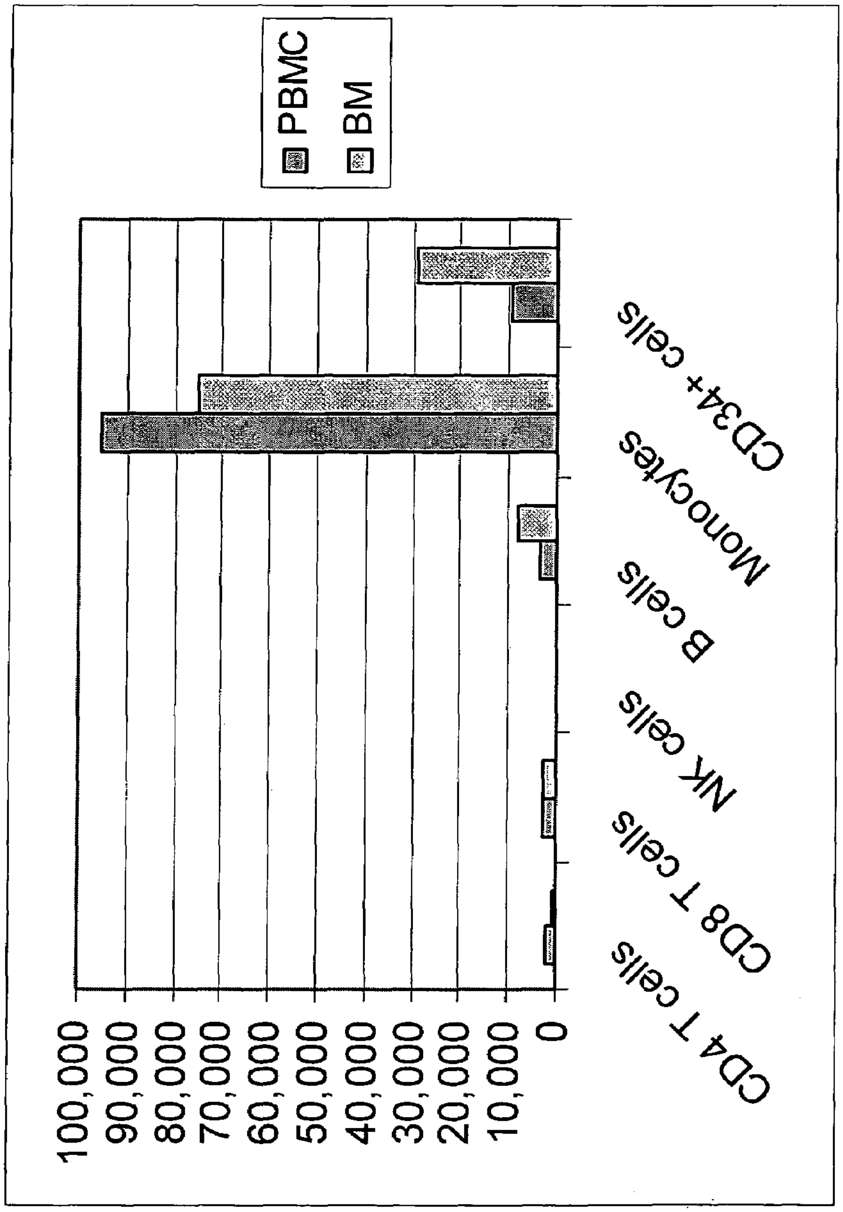

FIG. 103. CD98 Expression in PBMC and Bone Marrow by FACS.

Figure 104:
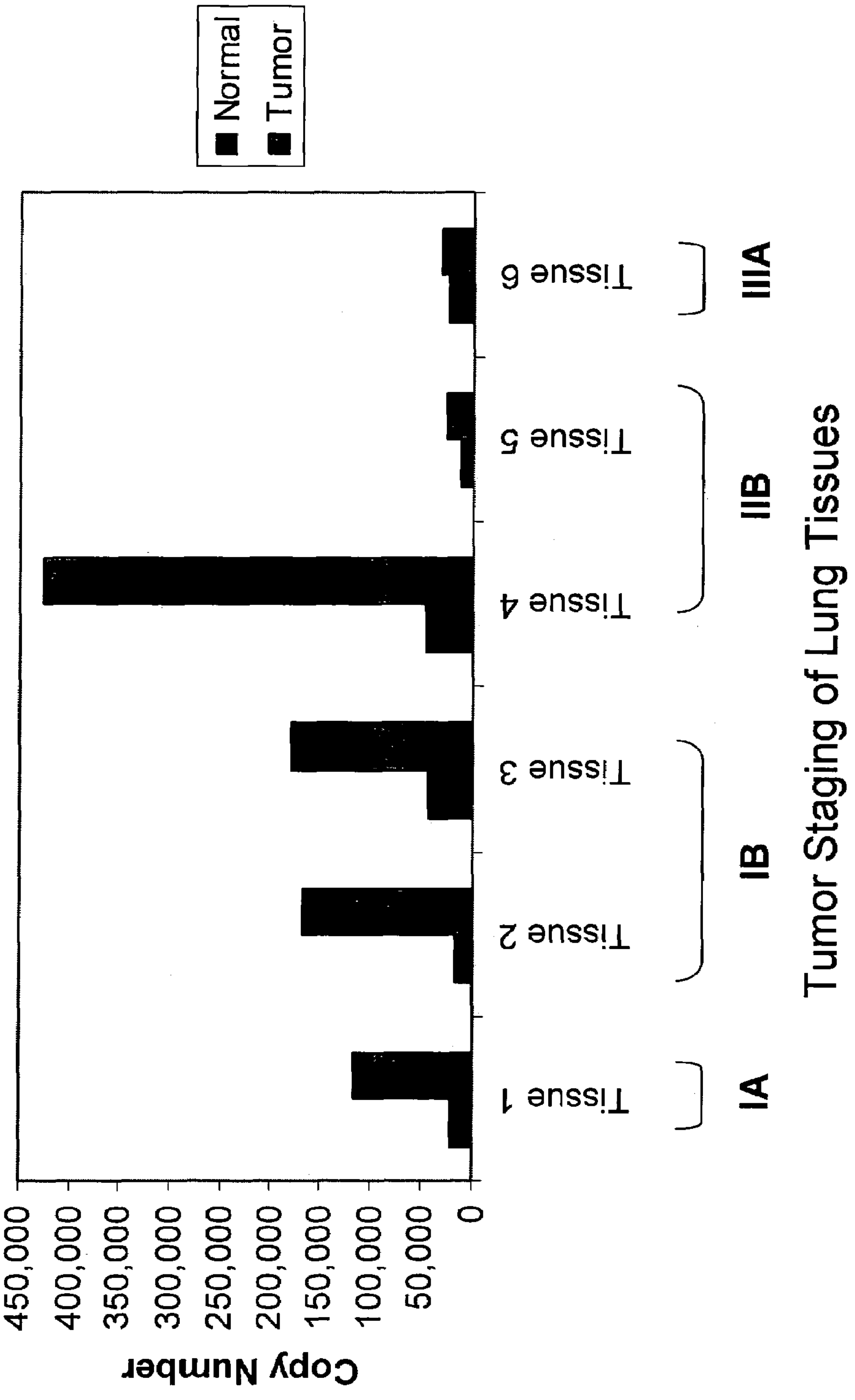

FIG. 104. CD98 Over-expression in Lung Tumors by QFACS.

Figure 105:
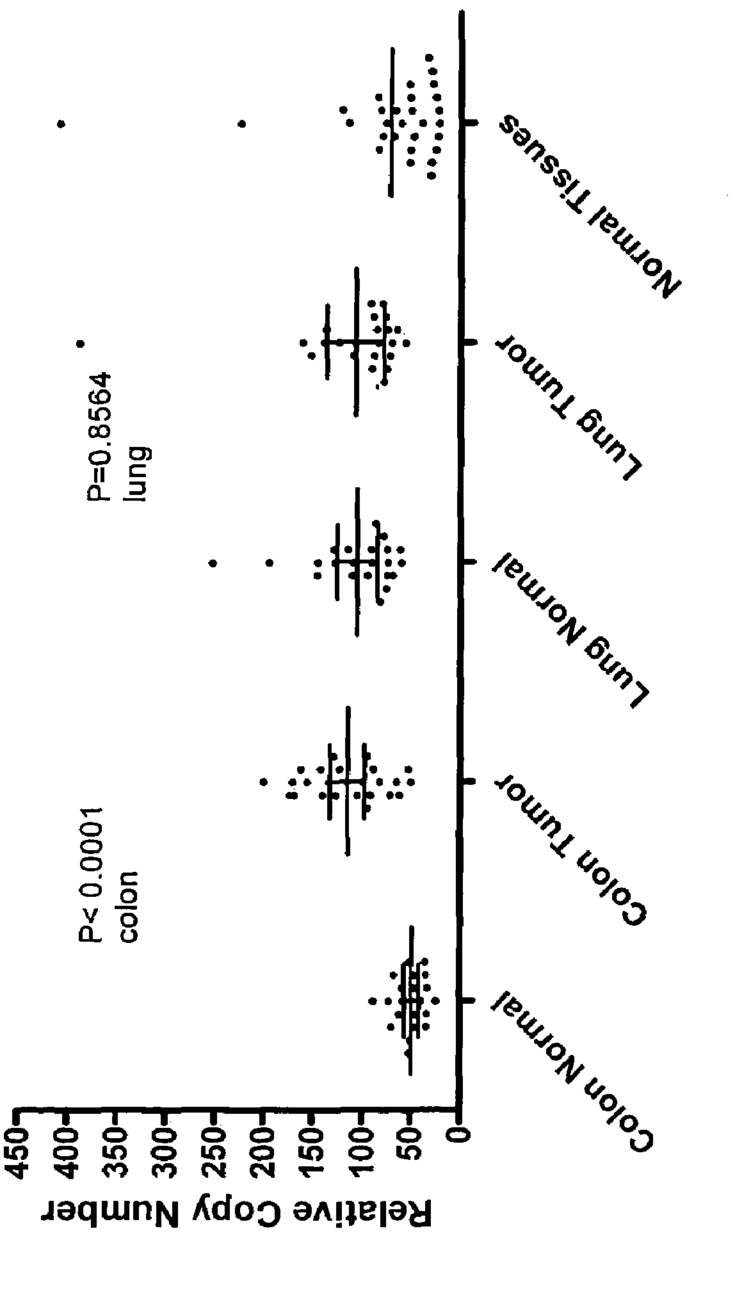

FIG. 105. CD98 mRNA Expression Analysis in Multiple Tumor Tissues.

Figure 106:
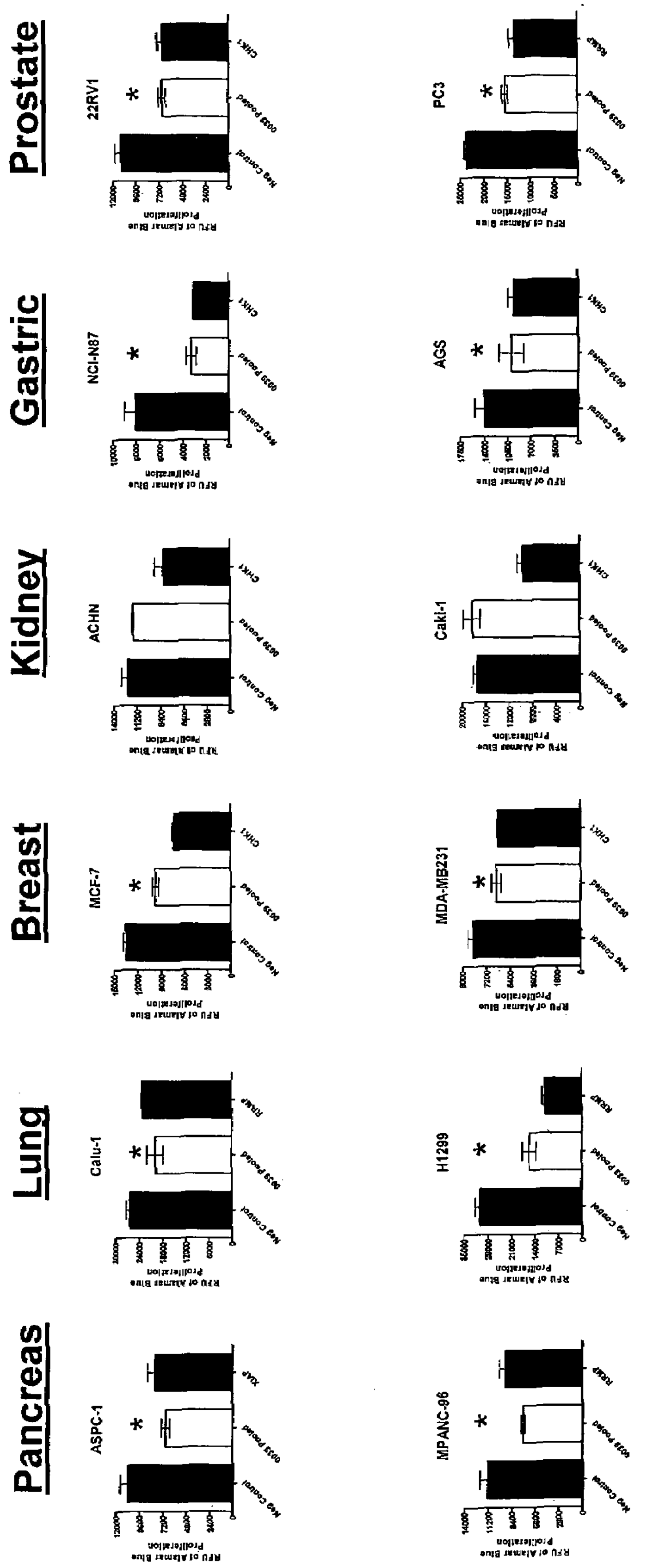

FIG. 106. Knockdown of CD98 mRNA Inhibits Proliferation in Pancreas, Lung and Breast Cancer Cells.

Figure 107:
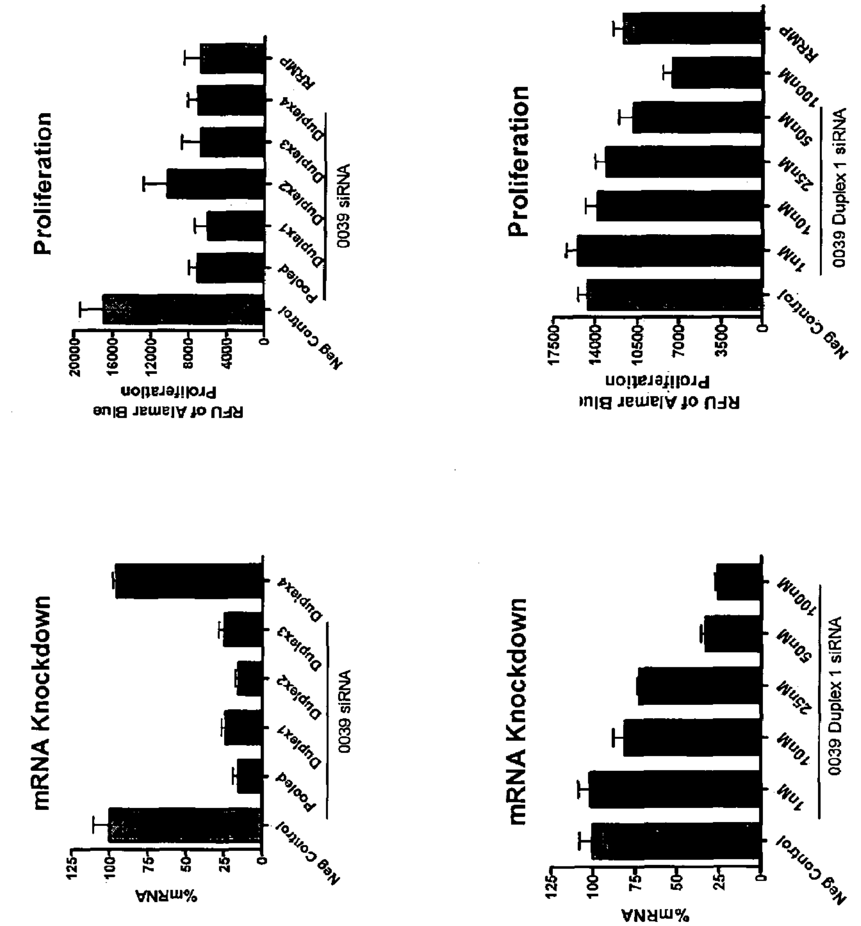

FIG. 107. Knockdown of CD98 mRNA Inhibits Proliferation in H1299 Lung Cancer Cells.

Figure 108:
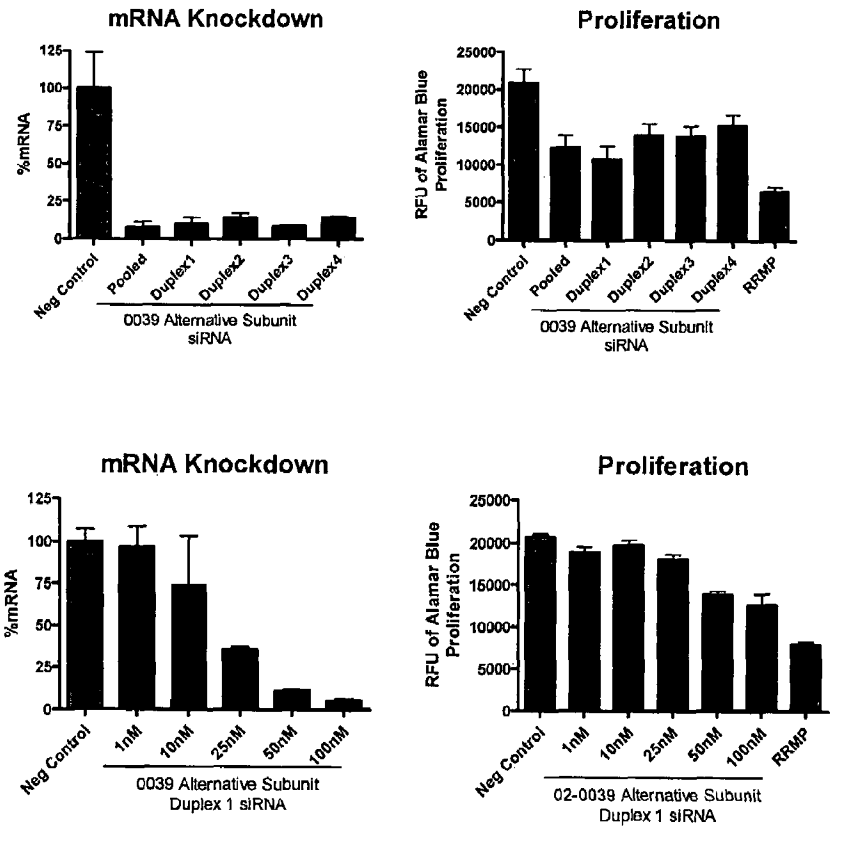

FIG. 108. Knockdown of Alternative CD98 Subunit mRNA Inhibits Proliferation in H1299 Lung Cancer Cells.

Figure 109:
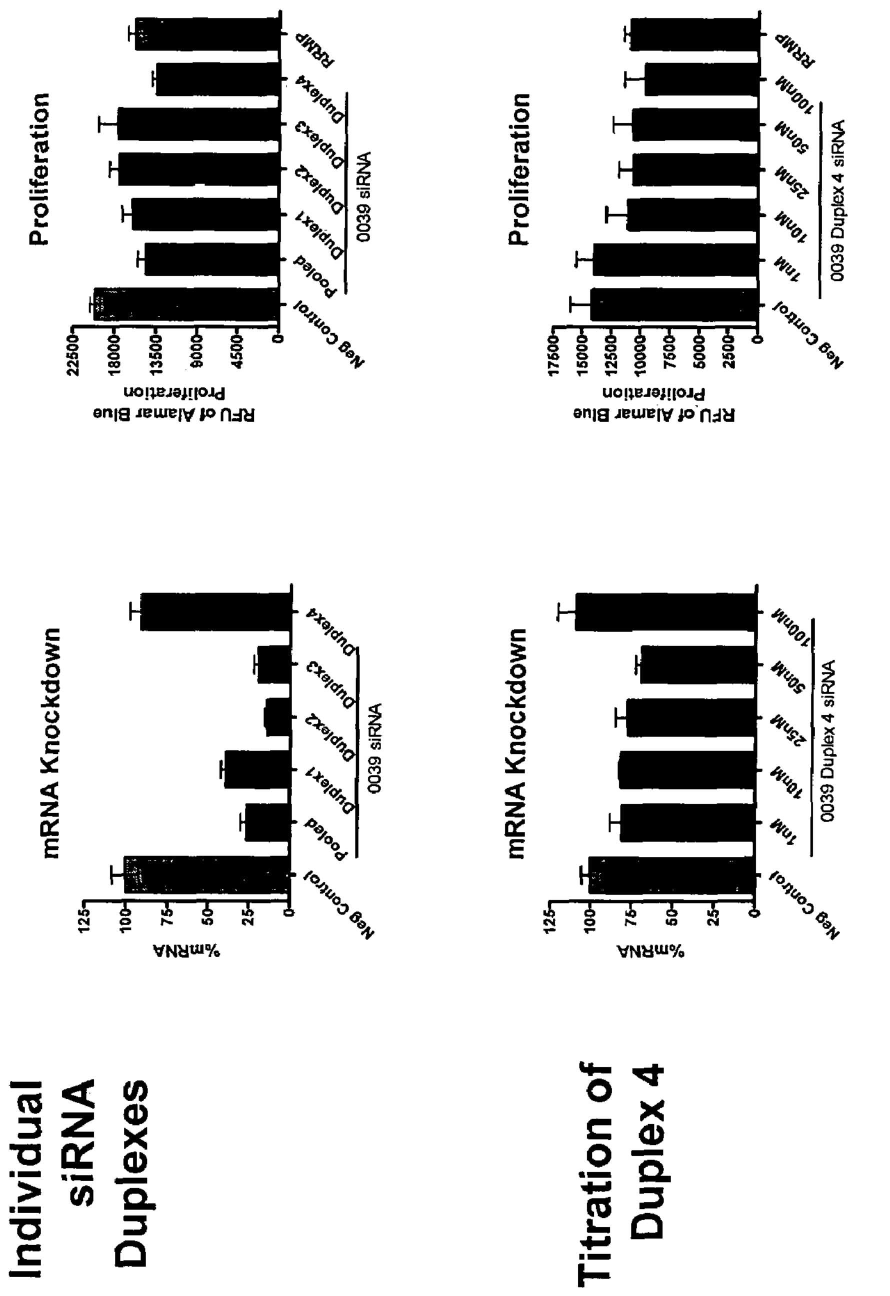

FIG. 109. Knockdown of CD98 mRNA Inhibits Proliferation in MPANC-96 Pancreatic Cancer Cells.

FIG. 110. mRNA sequence for CD98 light chain (SLC7A5), indicating siRNA target regions.

CD104

FIG. 111. CD104 is Over-expressed in Multiple Tumor Types.

FIG. 112. CD104 is Over-expressed in Multiple Tumor Types.

Figure 113:
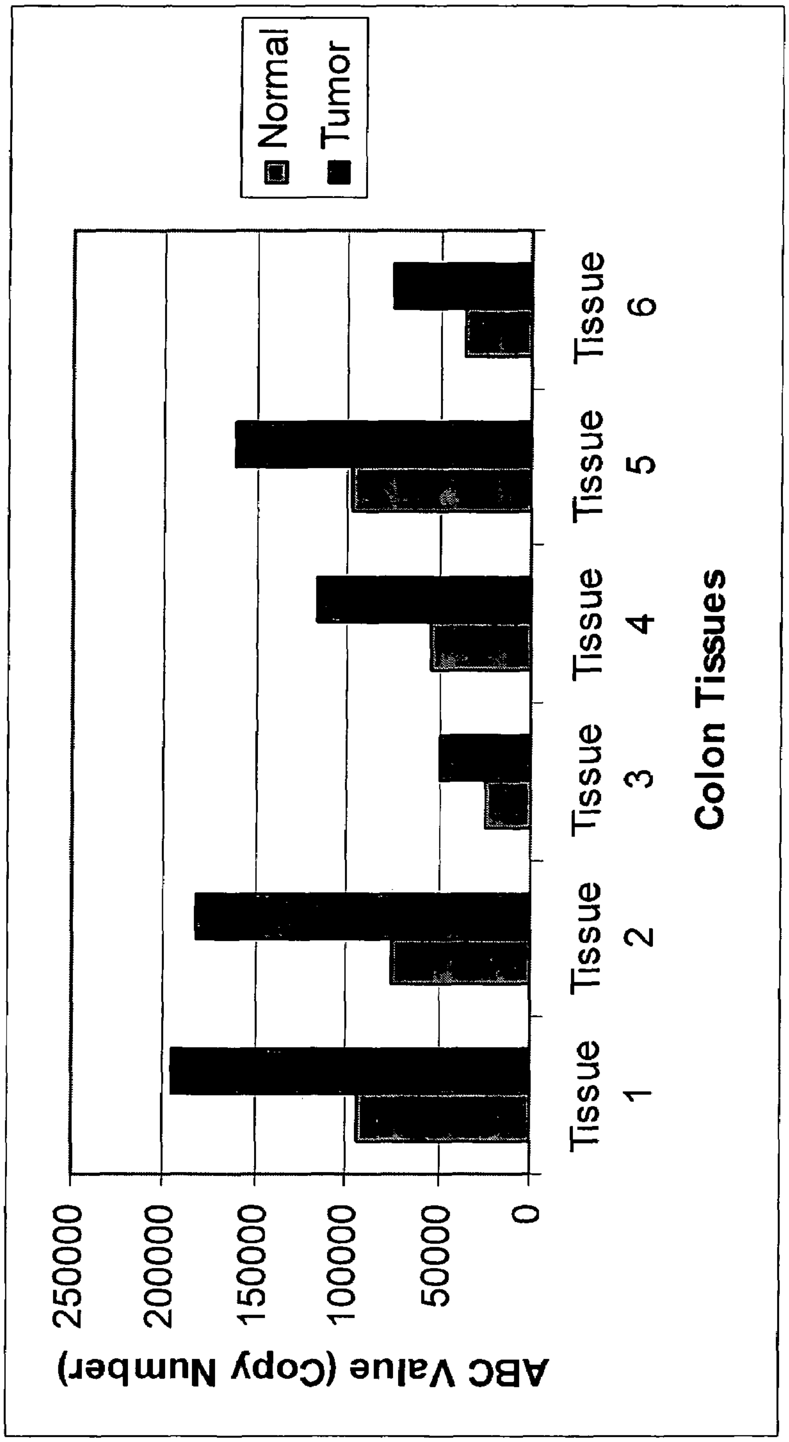

FIG. 113. CD104 is Over-expressed in Colon Tissues as Measured by QFACS.

Figure 114:
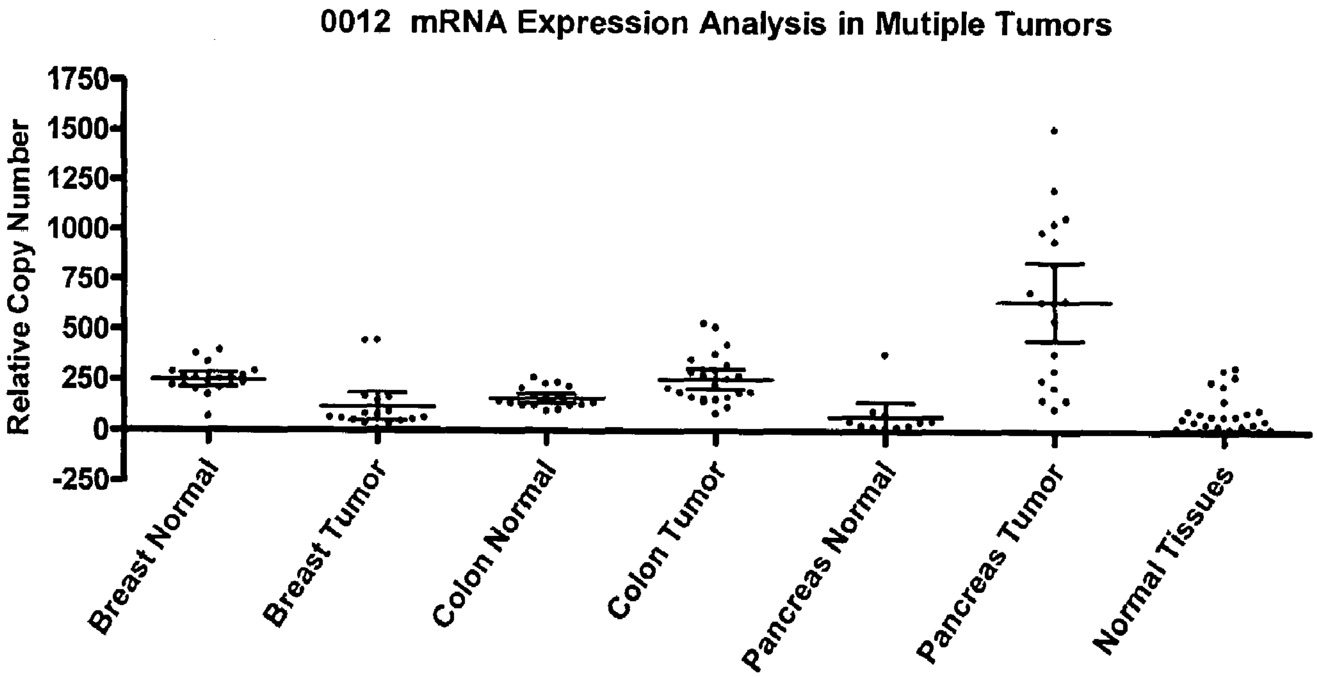

FIG. 114. CD104 mRNA Expression in Multiple Tumor Types.

Figure 115:
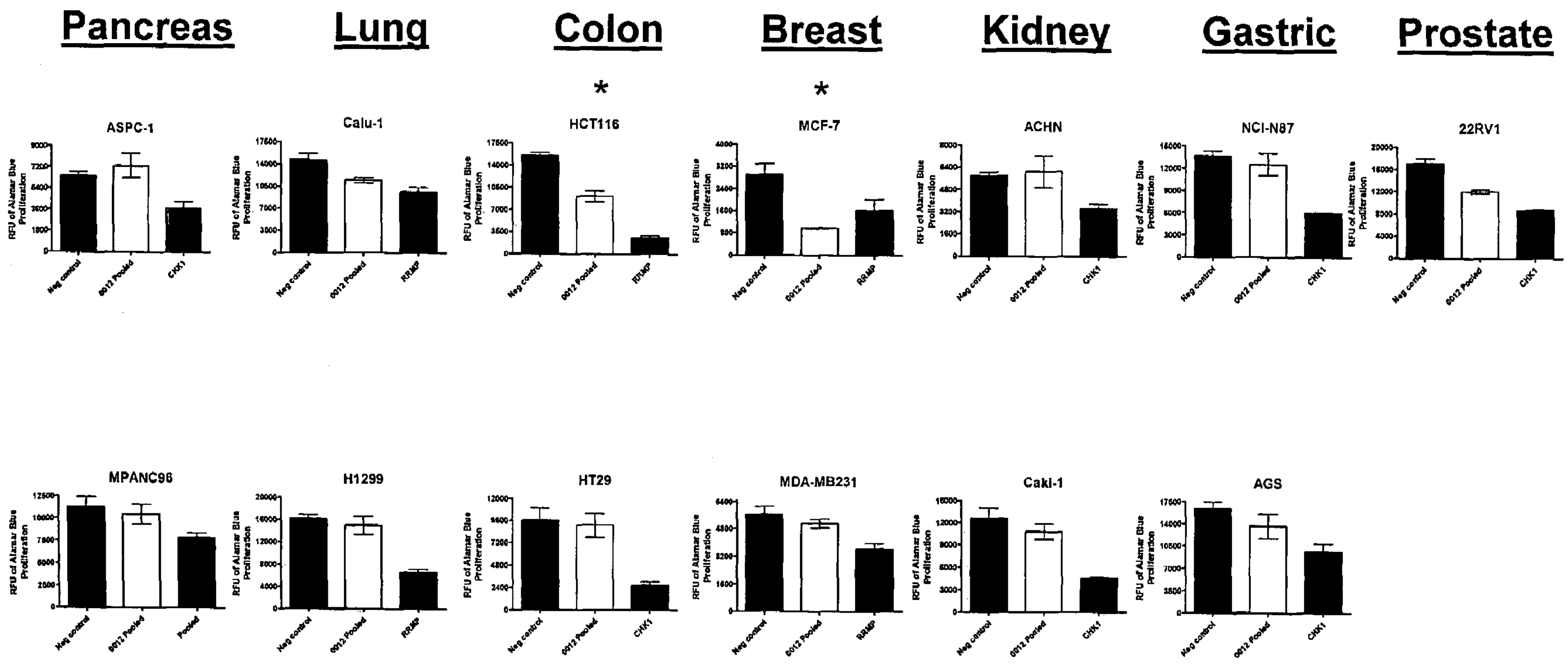

FIG. 115. Knockdown of CD104 mRNA Inhibits Proliferation in Colon and Breast Cancer Cells.

Figure 116:
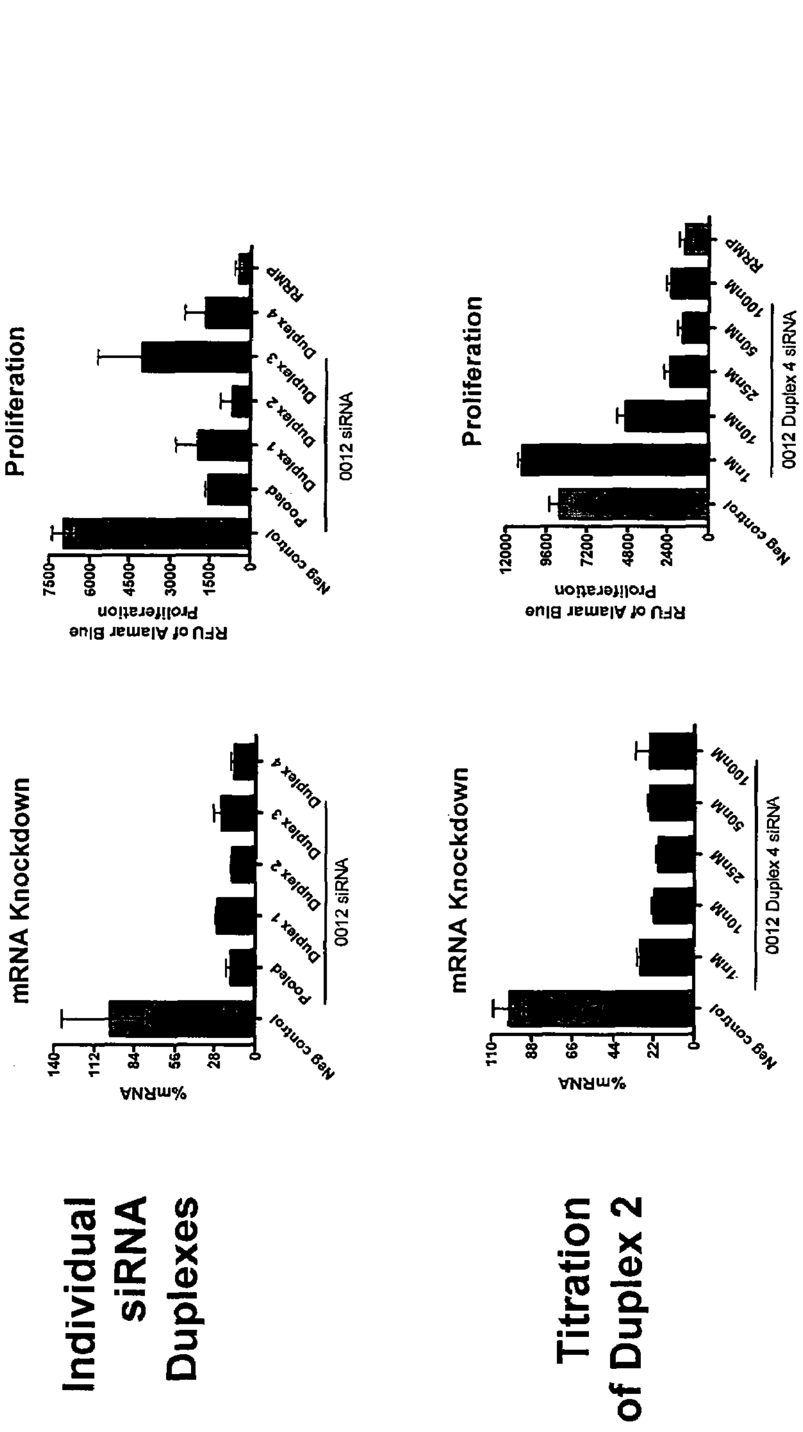

FIG. 116. Knockdown of CD104 mRNA Inhibits Proliferation in HCT116 Colon Cancer Cells.

FIG. 117. mRNA sequence of β4 Integrin (CD104), indicating siRNA target regions.

DPEP1

FIG. 118. DPEP1 is Over-Expressed in Colon Carcinoma.

Figure 119:
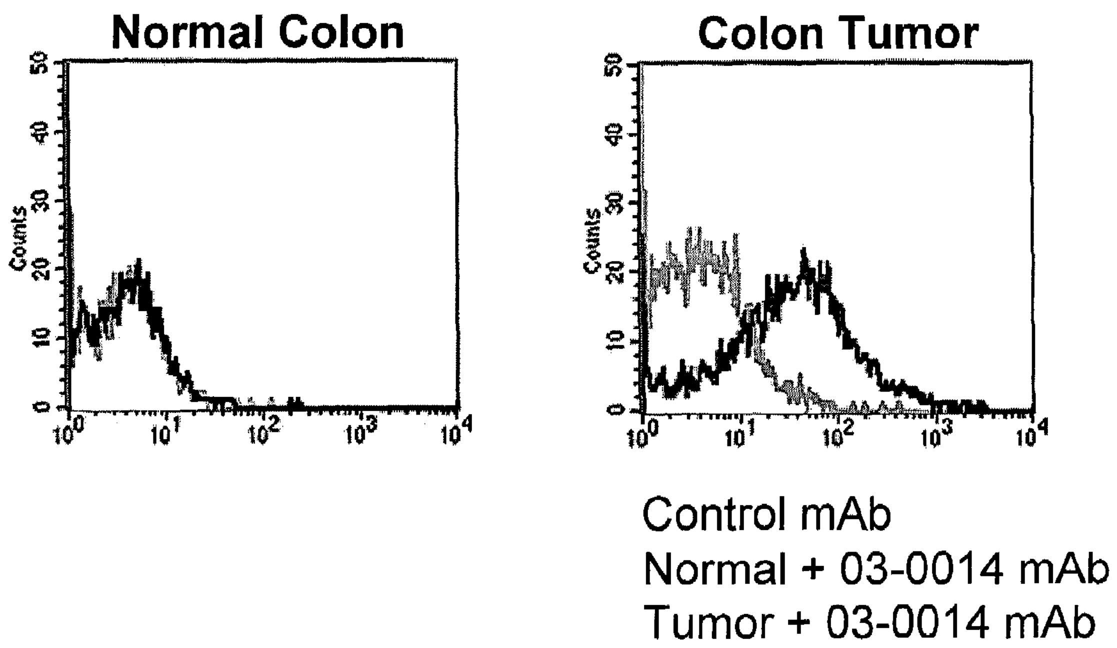

FIG. 119. FACS Confirms Over-Expression of DPEP1 on the Surface of Colon Tumors.

Figure 120:
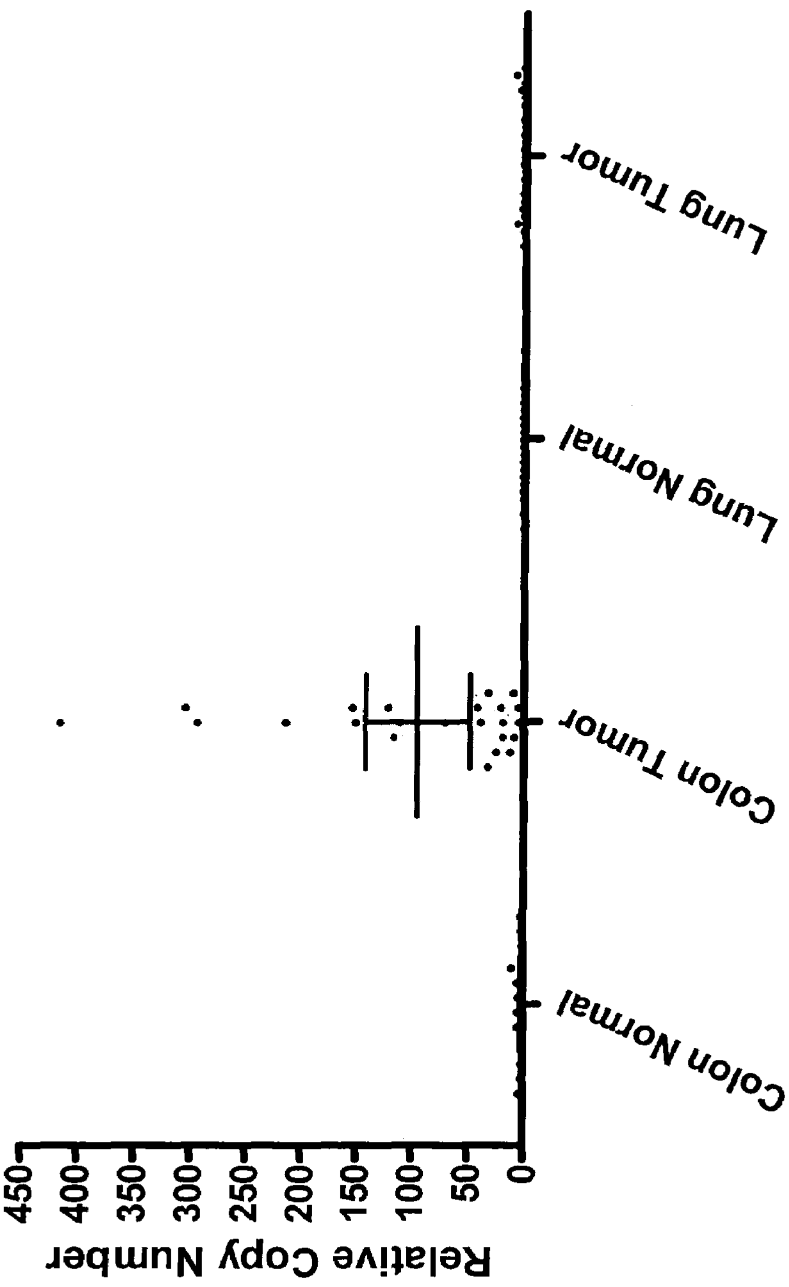

FIG. 120. DPEP1 mRNA Expression Analysis in Colon and Lung Tumor Tissues.

Figure 121:
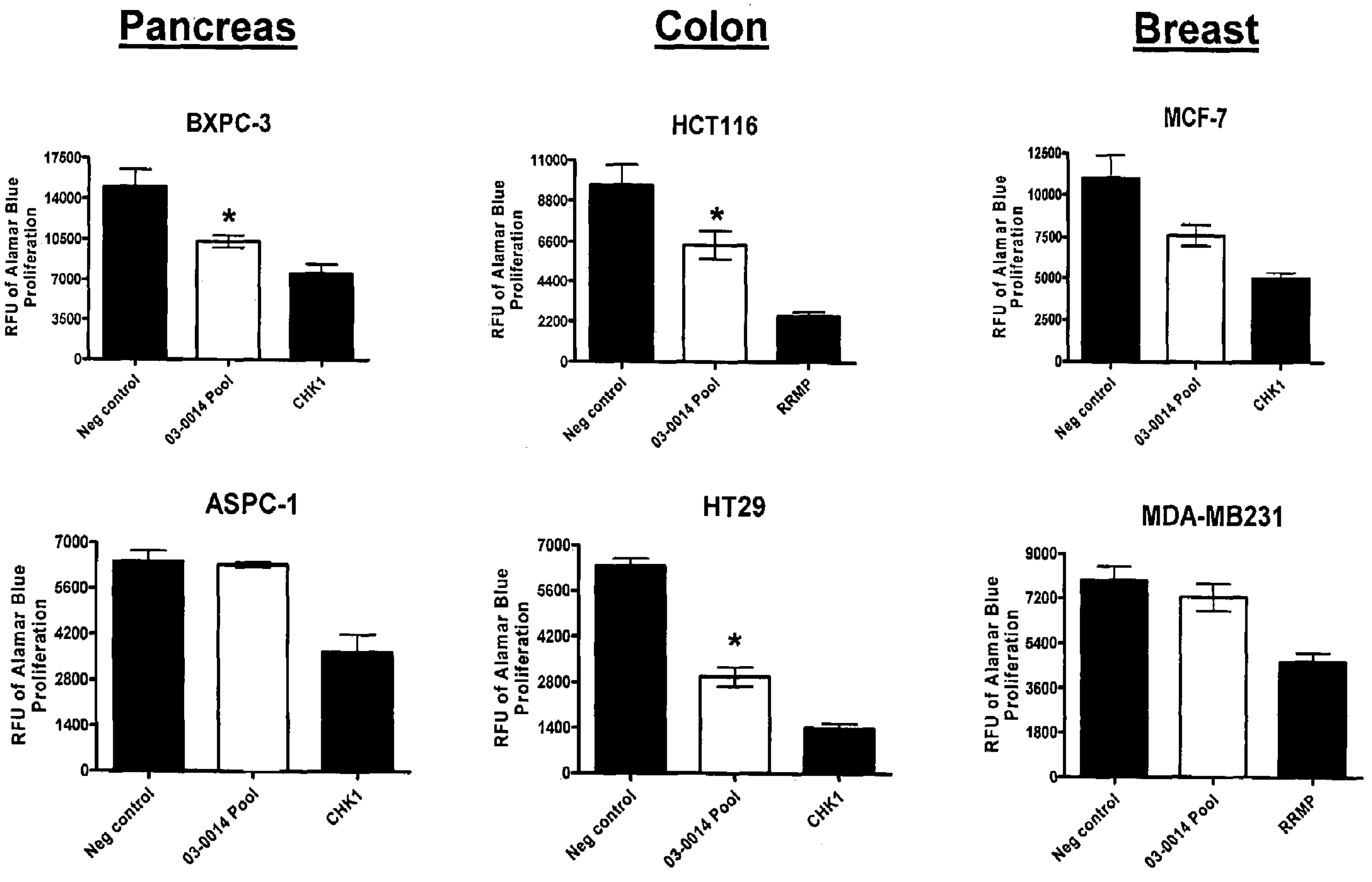

FIG. 121. Knockdown of DPEP1 mRNA Inhibits Proliferation in Colon Cancer Cells.

Figure 122:
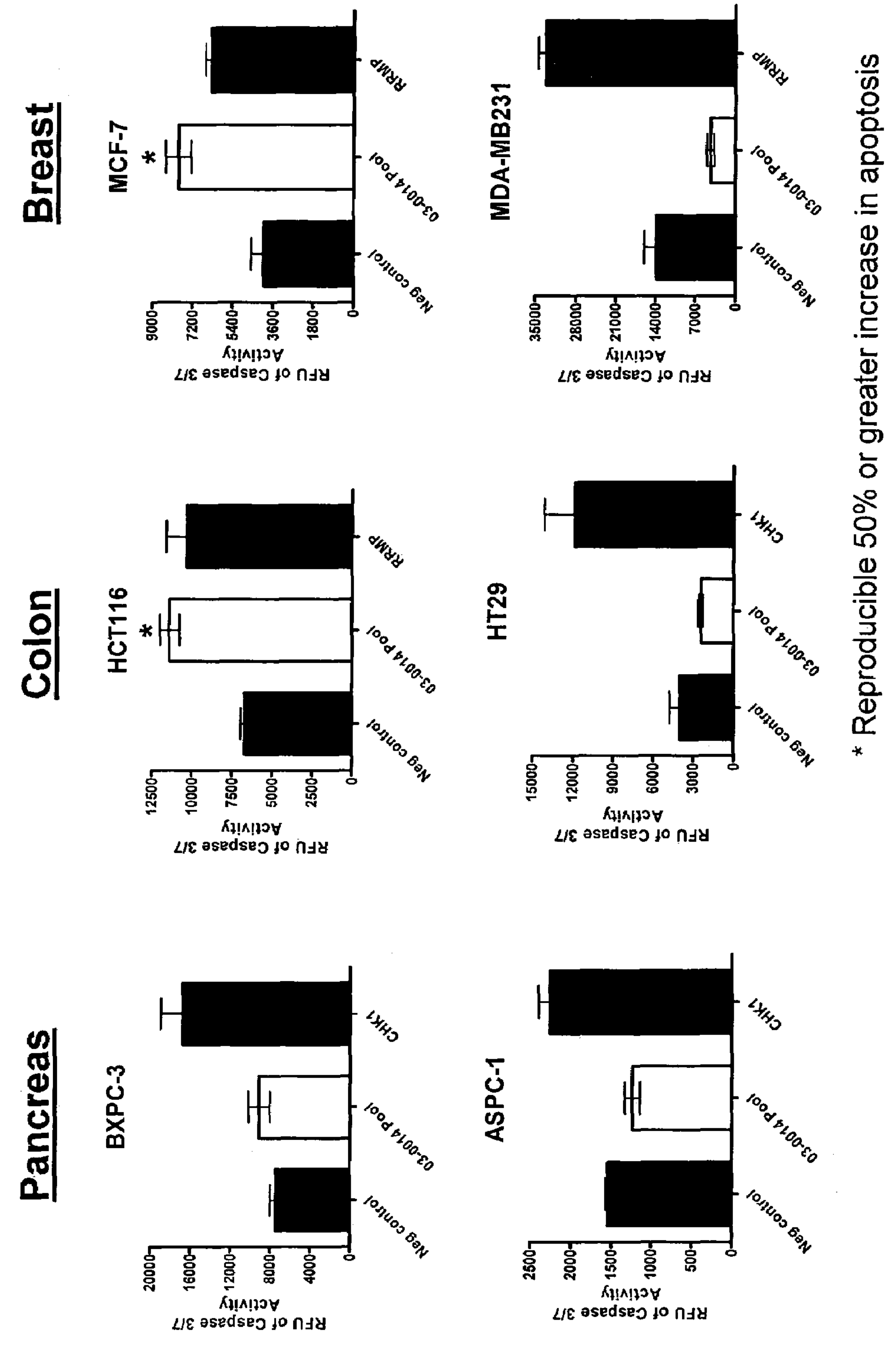

FIG. 122. Knockdown of DPEP1 mRNA Increases Apoptosis in Colon Cancer Cells.

Figure 123:
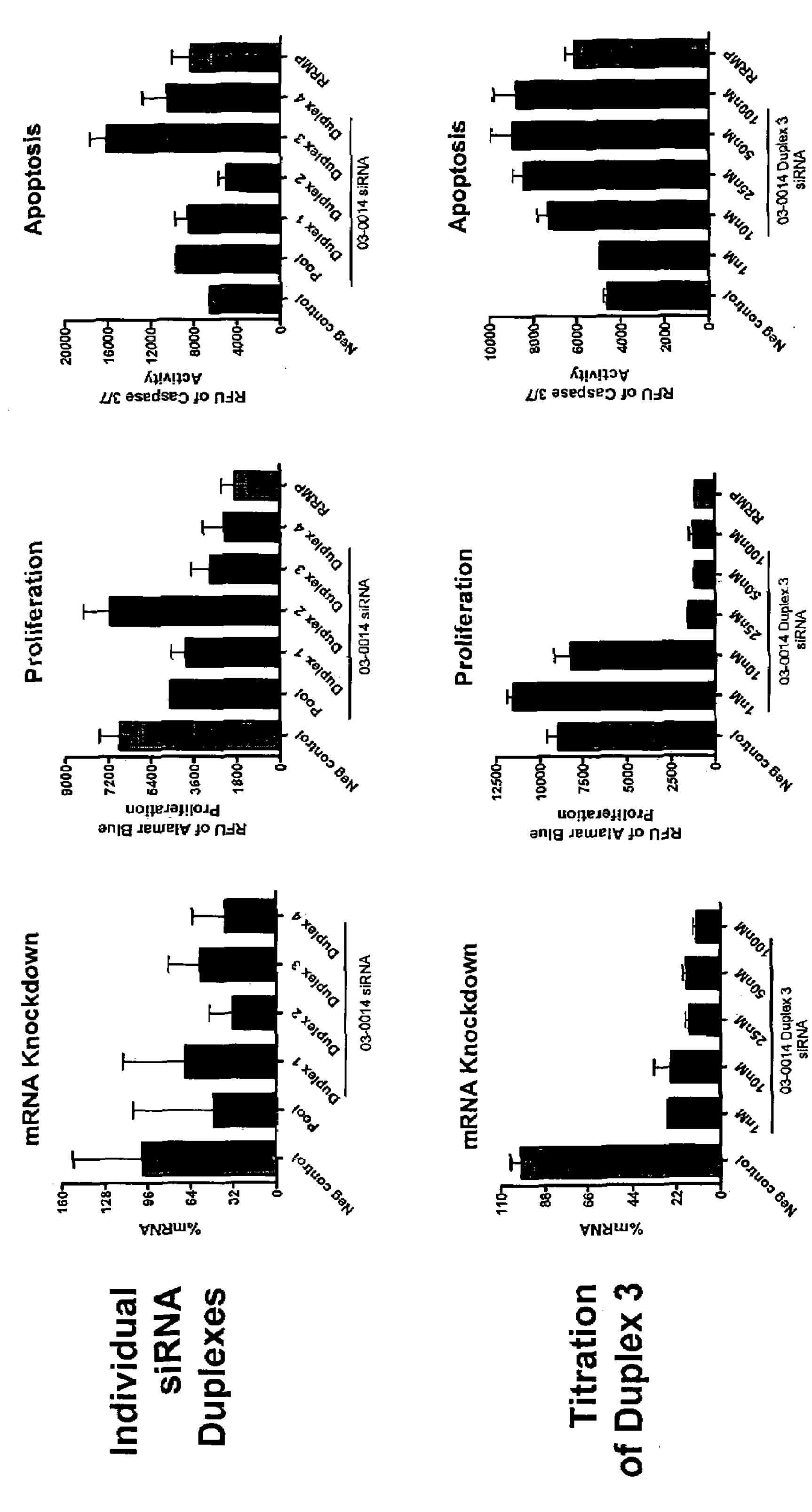

FIG. 123. Knockdown of DPEP1 mRNA Inhibits Proliferation and Induces Apoptosis in HCT116 Colon Cancer Cells.

Figure 124:
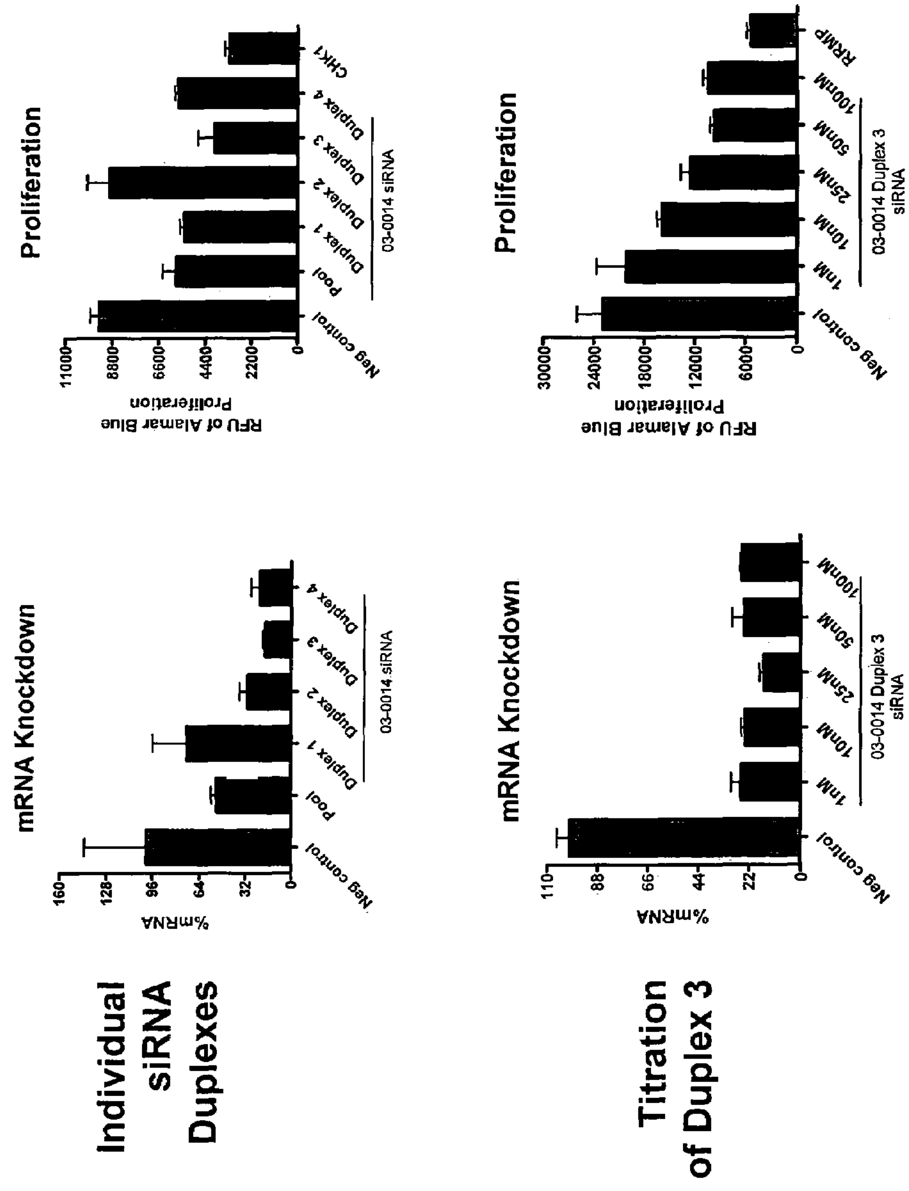

FIG. 124. Knockdown of DPEP1 mRNA Inhibits Proliferation in HT29 Colon Cancer Cells.

Figure 125:
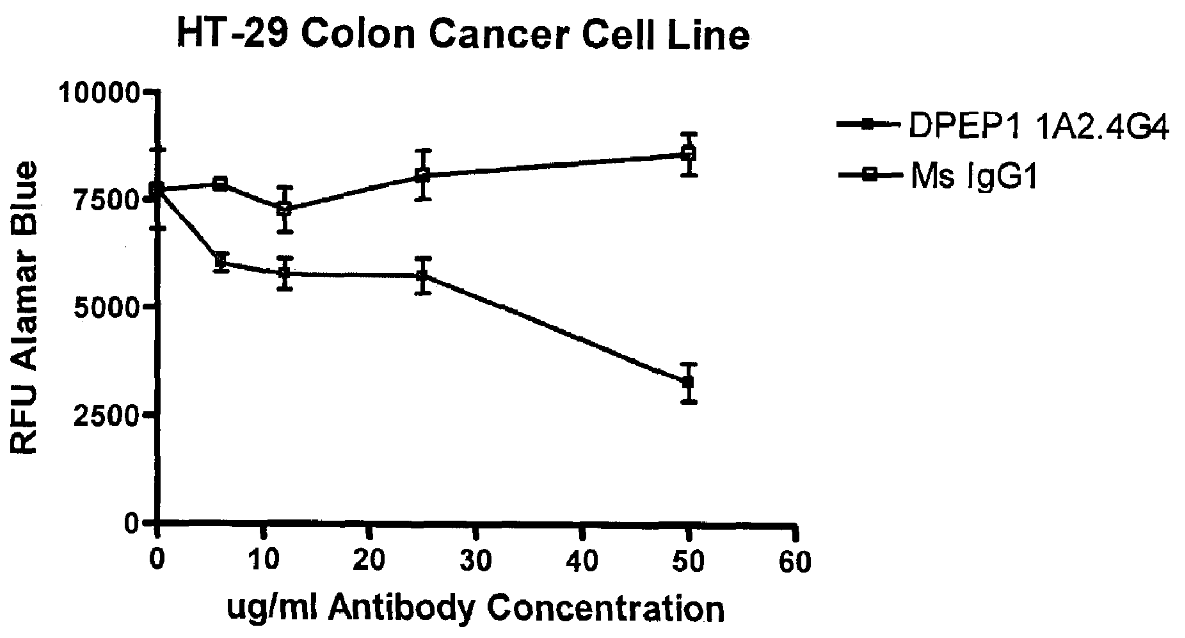

FIG. 125. Monoclonal Antibody to DPEP1 Inhibits Proliferation in Colon Cancer Cells.

Figure 126:
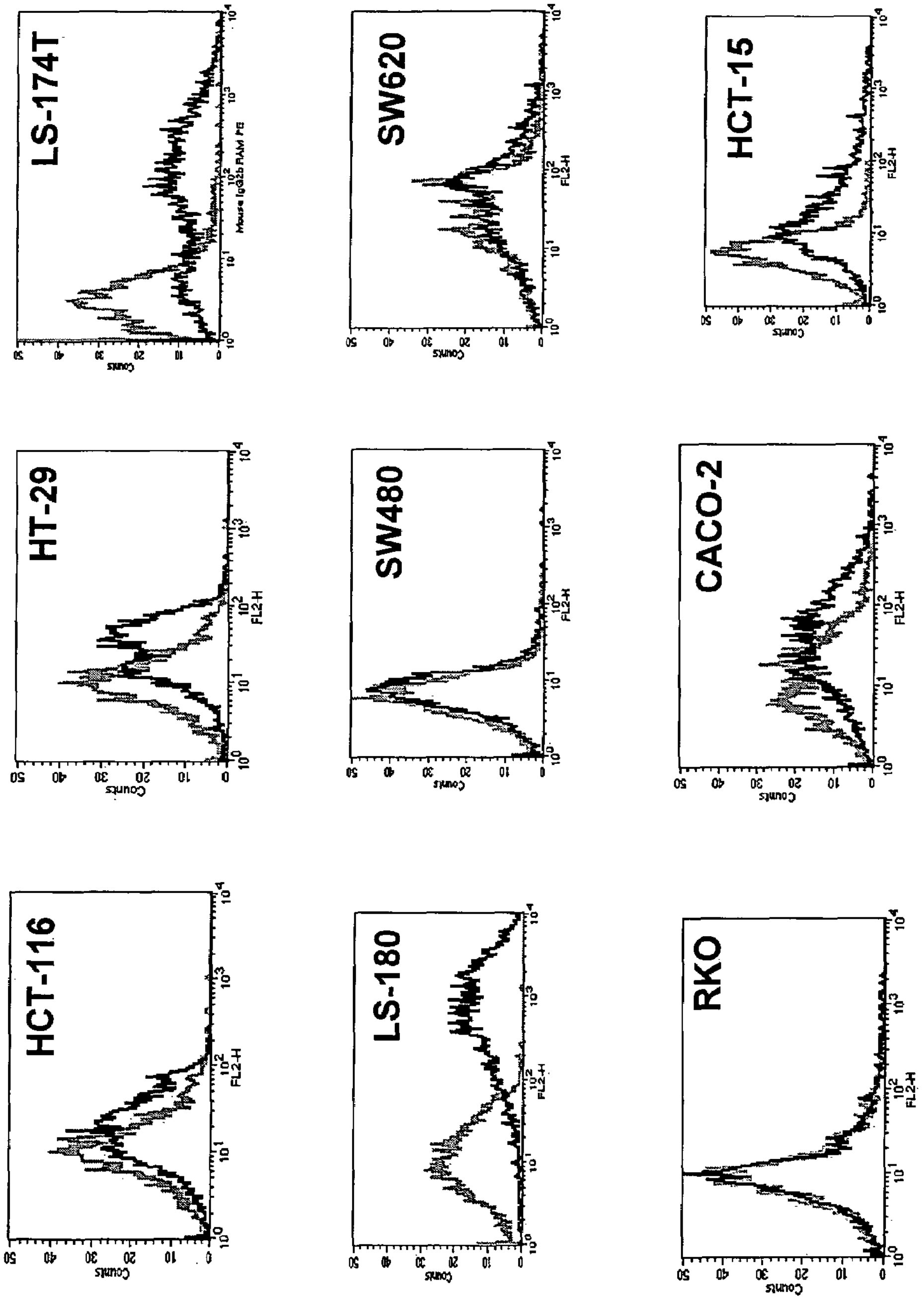

FIG. 126. DPEP1 Expression in Colon Cell Lines.

FIG. 127. mRNA sequence of DPEP1, indicating siRNA target regions.

Tissue Factor (TF)

FIG. 128. TF is Overexpressed in Multiple Tumor Types.

Figure 129:
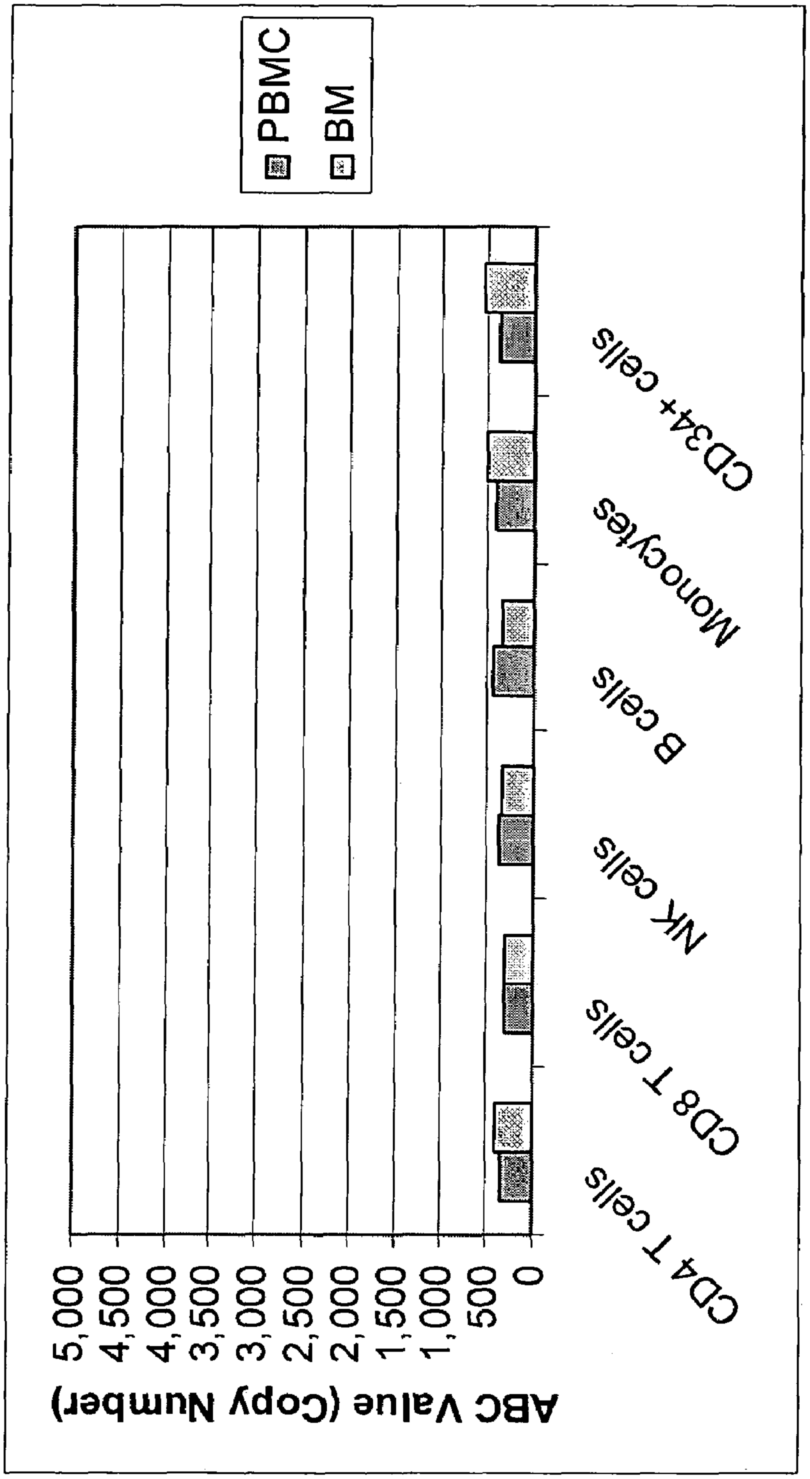

FIG. 129. TF Expression in PBMC and Bone Marrow.

Figure 130:
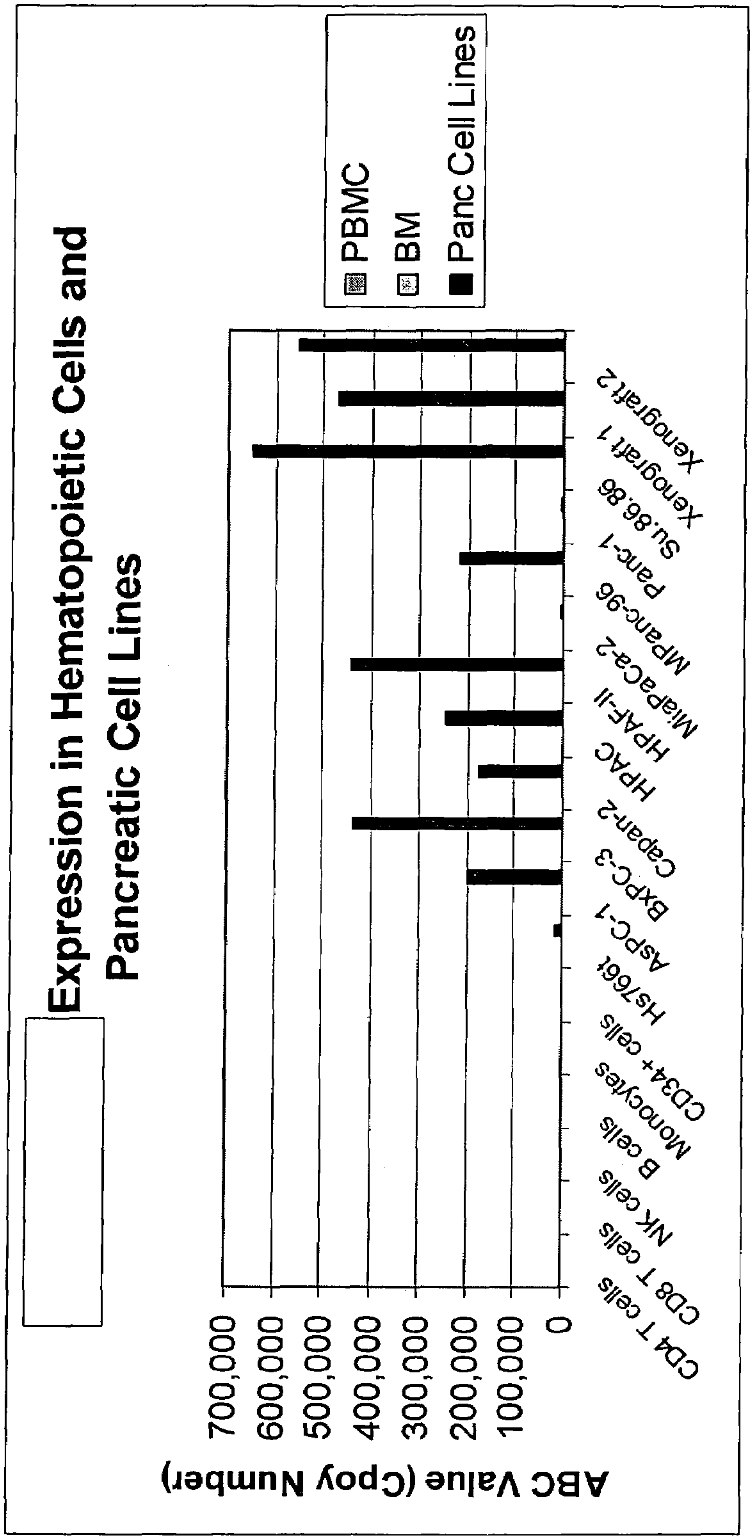

FIG. 130. TF Expression in Hematopoietic Cells and Pancreatic Cell Lines Measured by QFACS.

Figure 131:
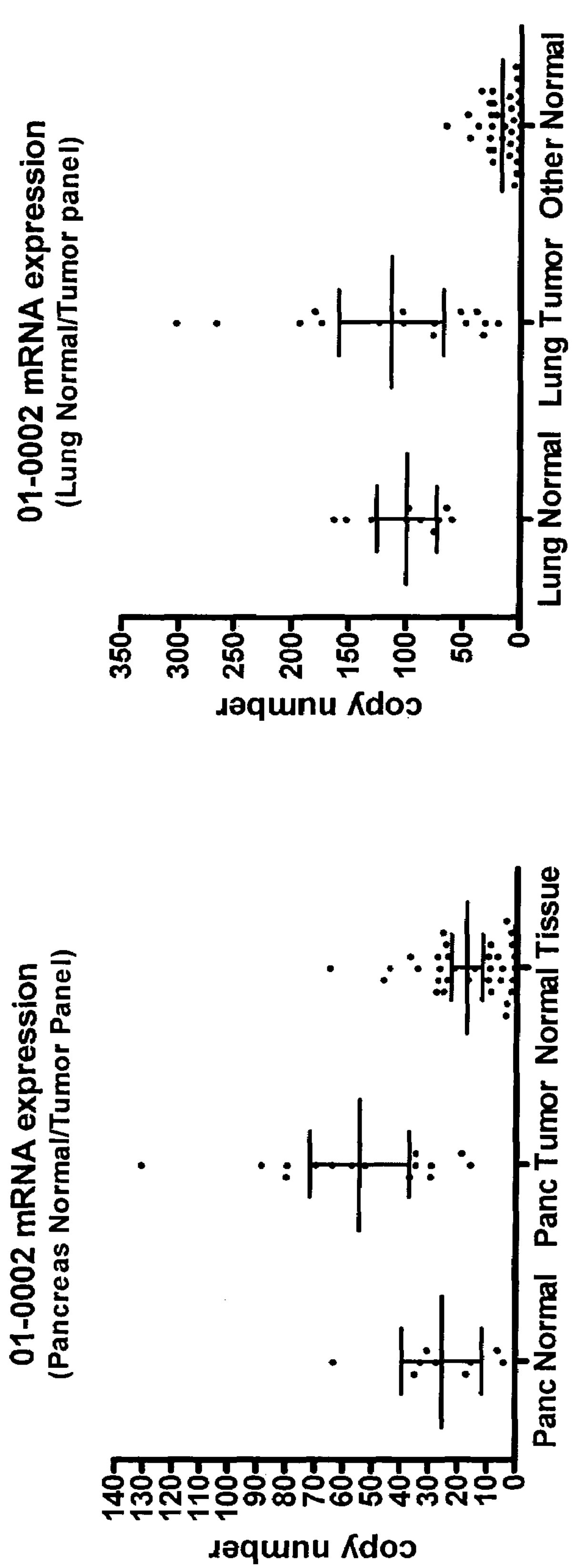

FIG. 131. TF mRNA Expression Analysis in Pancreatic and Lung Tumor Tissues.

Figure 132:
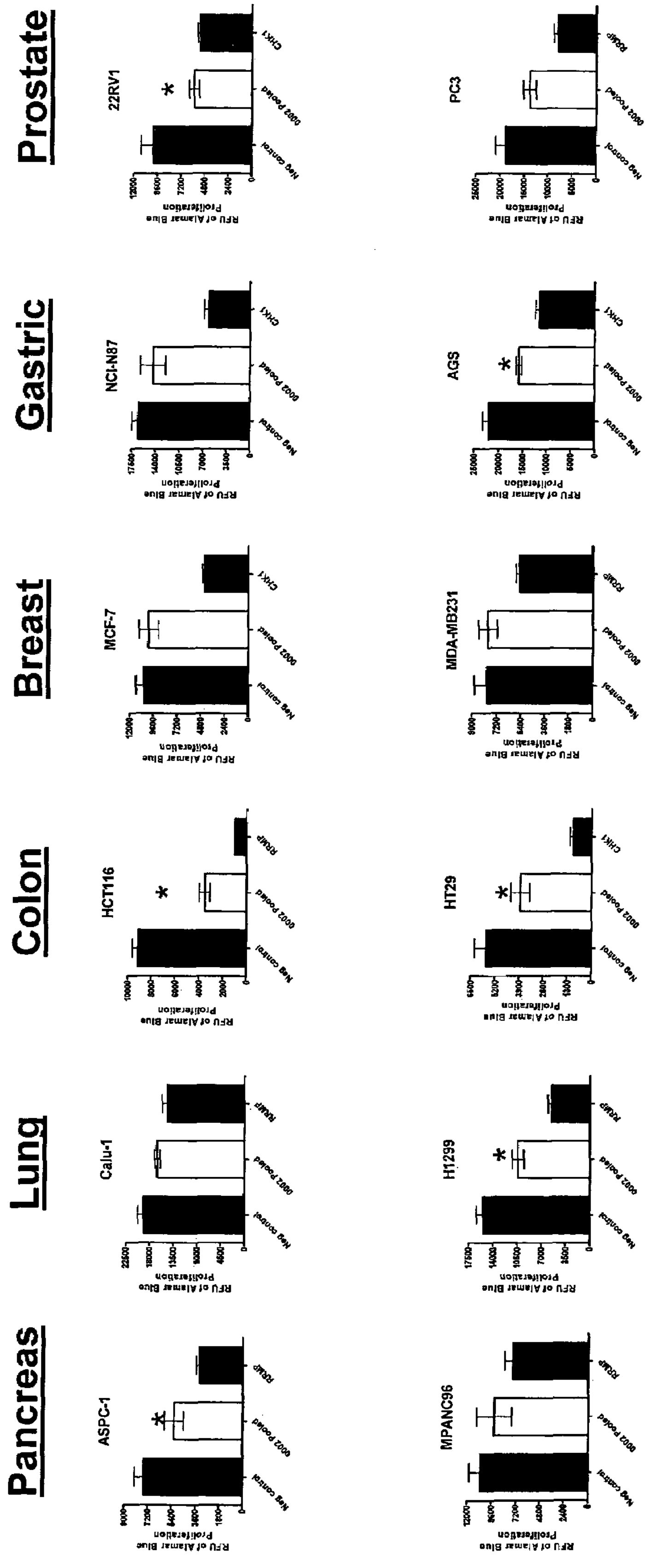

FIG. 132. Knockdown of TF mRNA Inhibits Proliferation in Multiple Cancer Cells.

Figure 133:
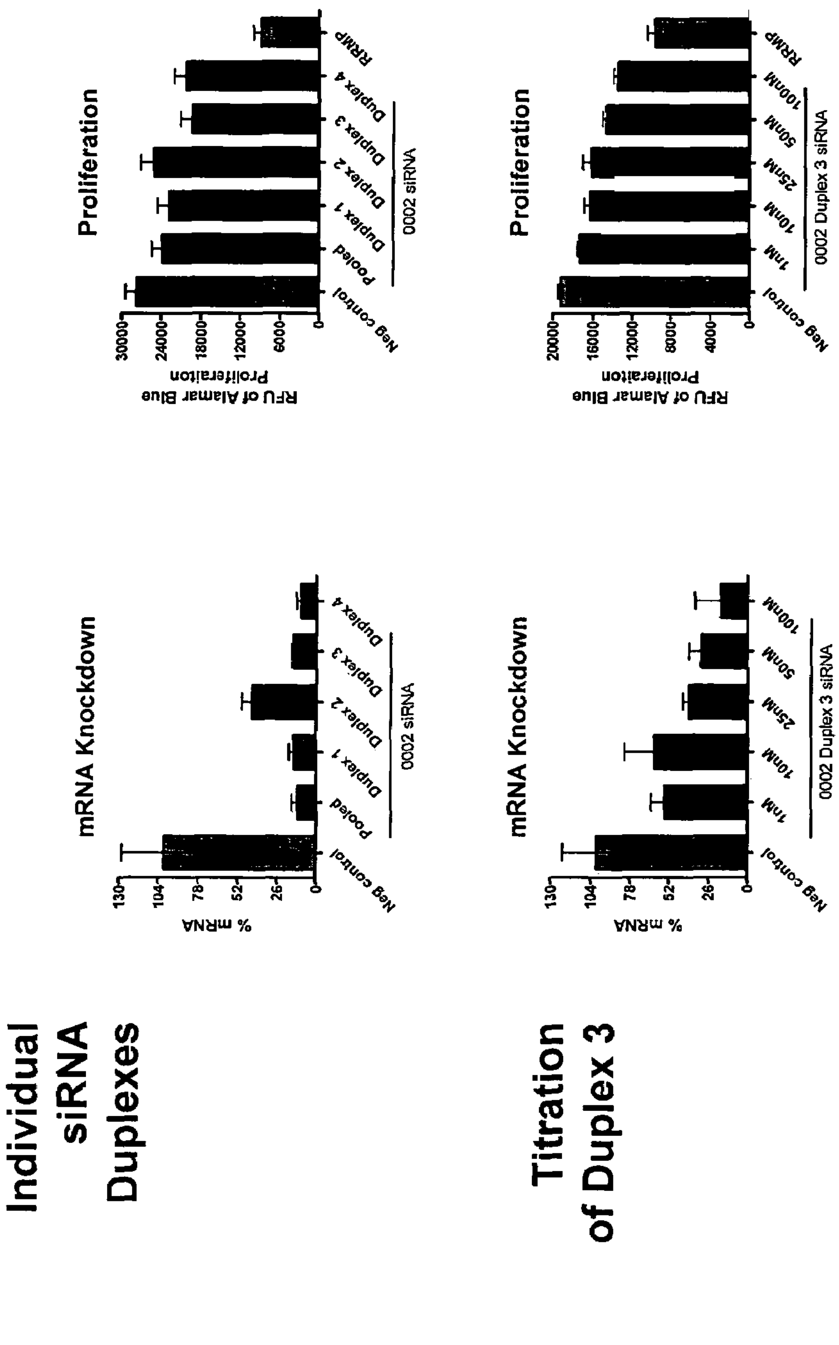

FIG. 133. RNAi Knockdown of TF mRNA Inhibits Proliferation in H1299 Lung Cancer Cells.

FIG. 134. RNAi Knockdown of TF mRNA Inhibits Proliferation in ASPC-1 Pancreatic Cancer Cells.

Figure 135:
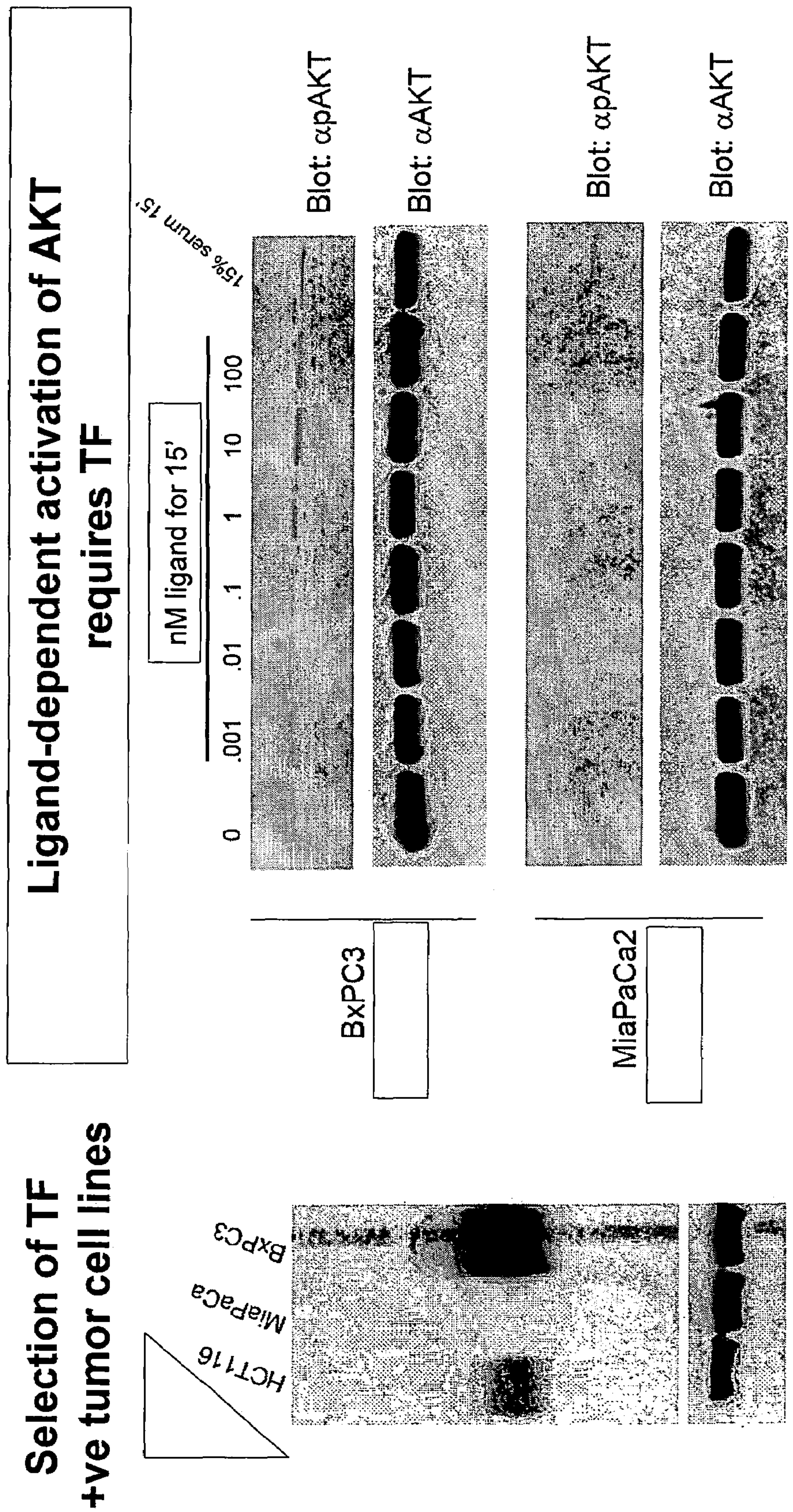

FIG. 135. TF-Ligand Activates AKT Signaling Pathway.

Figure 136:
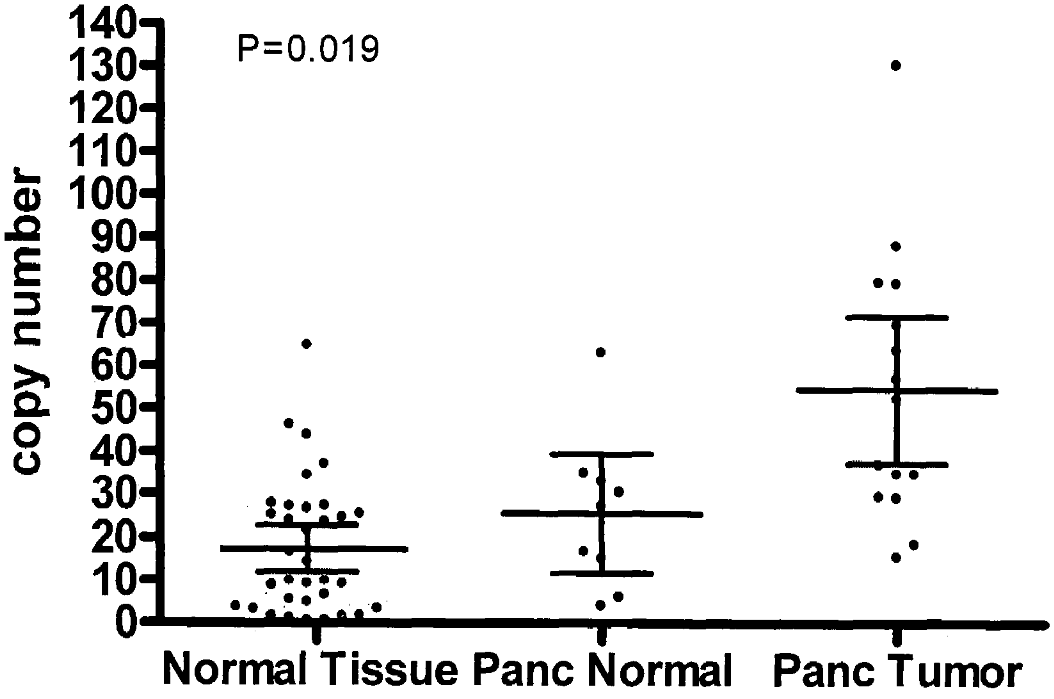

FIG. 136. Elevated Expression of Tissue Factor mRNA in Pancreatic Tumor Tissues.

Figure 137:
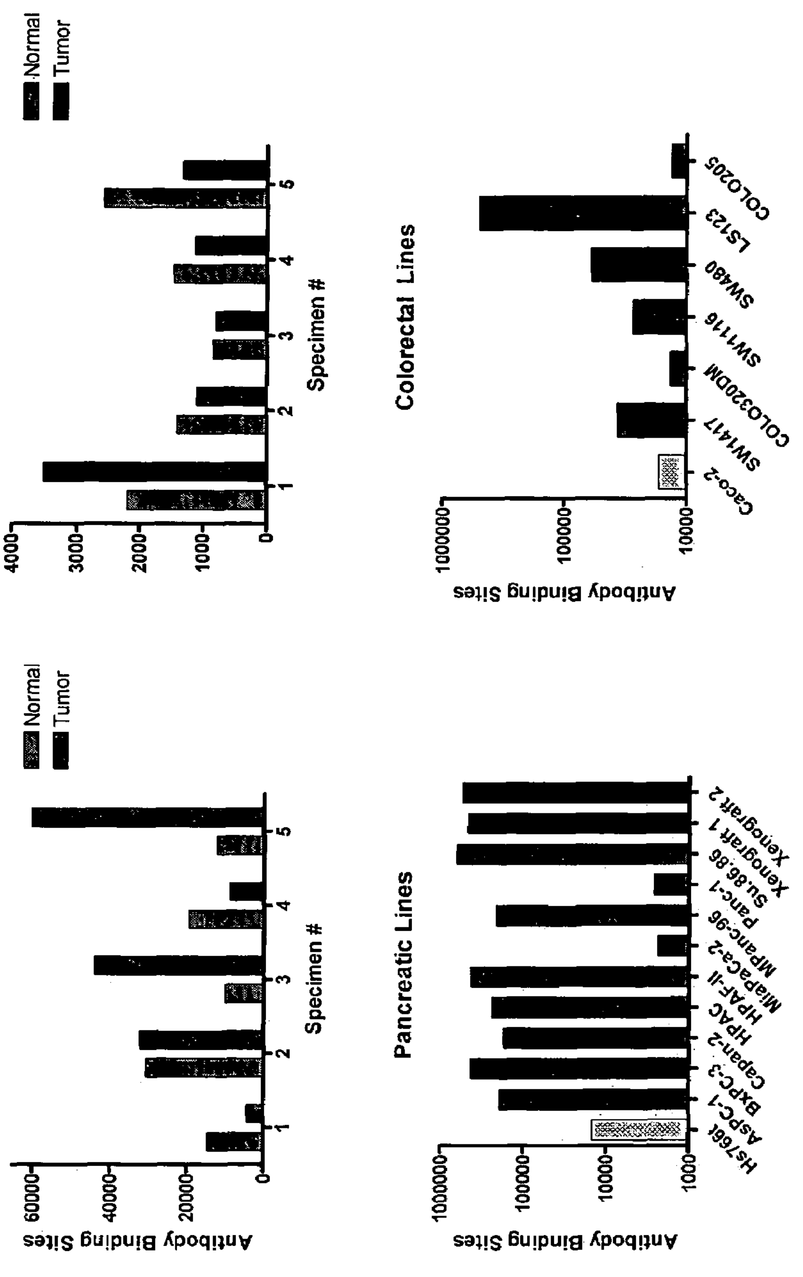

FIG. 137. QFACS validation of TF cell-surface tumor expression.

FIG. 138. mRNA sequence of Tissue Factor, indicating siRNA target regions.

Na-K ATPase Beta3

FIG. 139. Na-K ATPase β3 is Overexpressed in Multiple Tumor Types.

Figure 140:
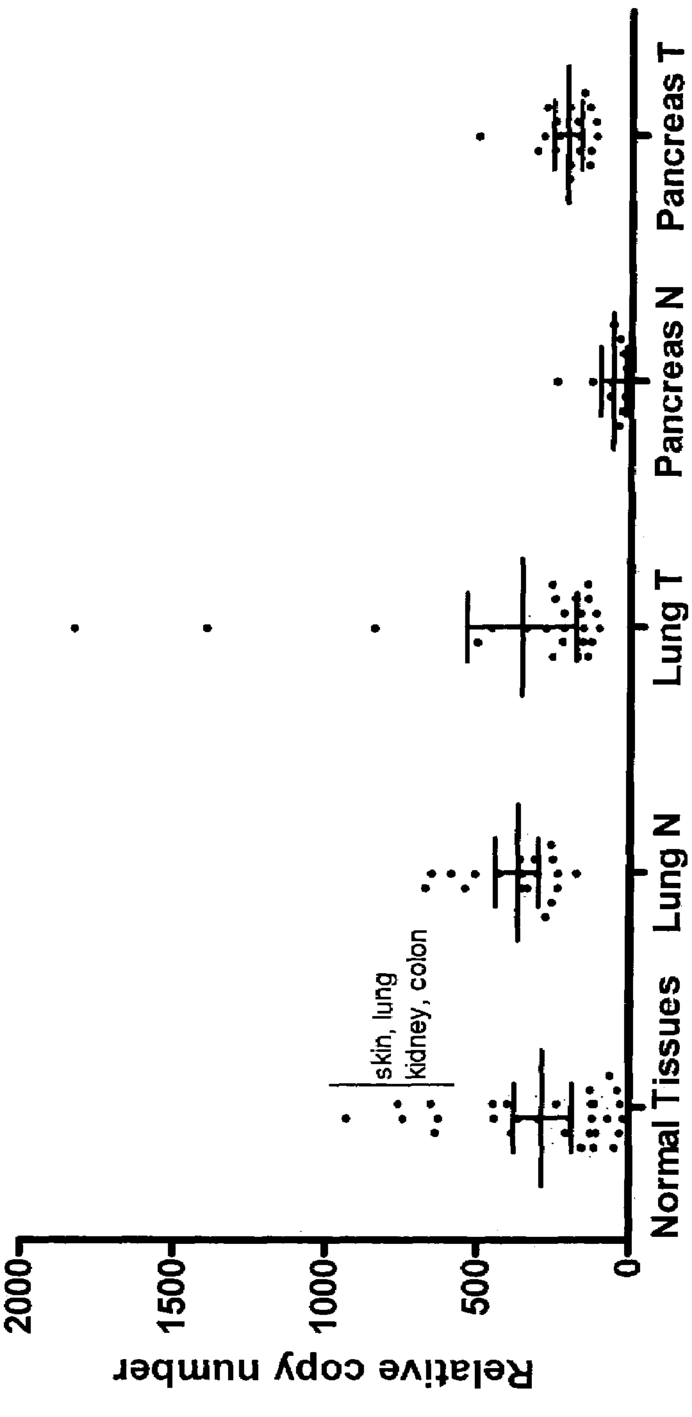

FIG. 140. Na-K ATPase β3 mRNA Overexpression Lung and Pancreas Tumor Panel.

Figure 141:
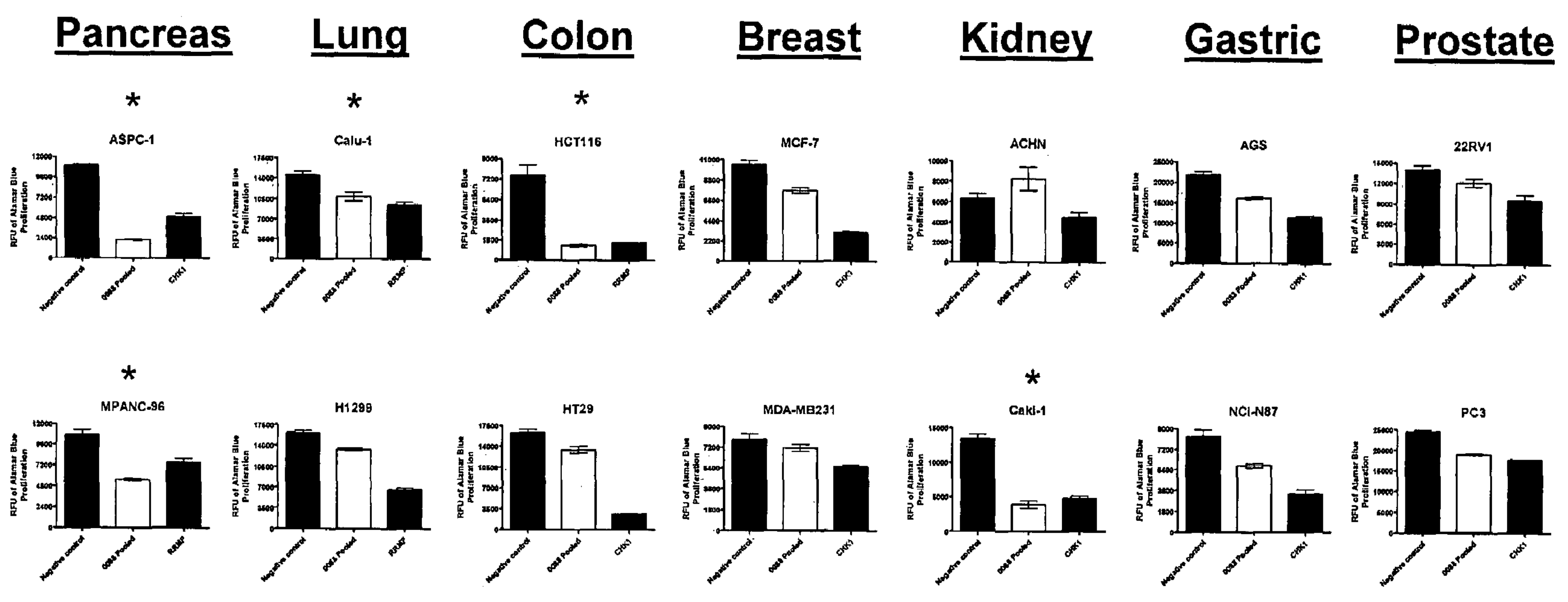

FIG. 141. RNAi Knockdown of Na-K ATPase β3 mRNA Inhibits Proliferation in Pancreatic, Lung, Colon, and Kidney Cancer Cells.

Figure 142:
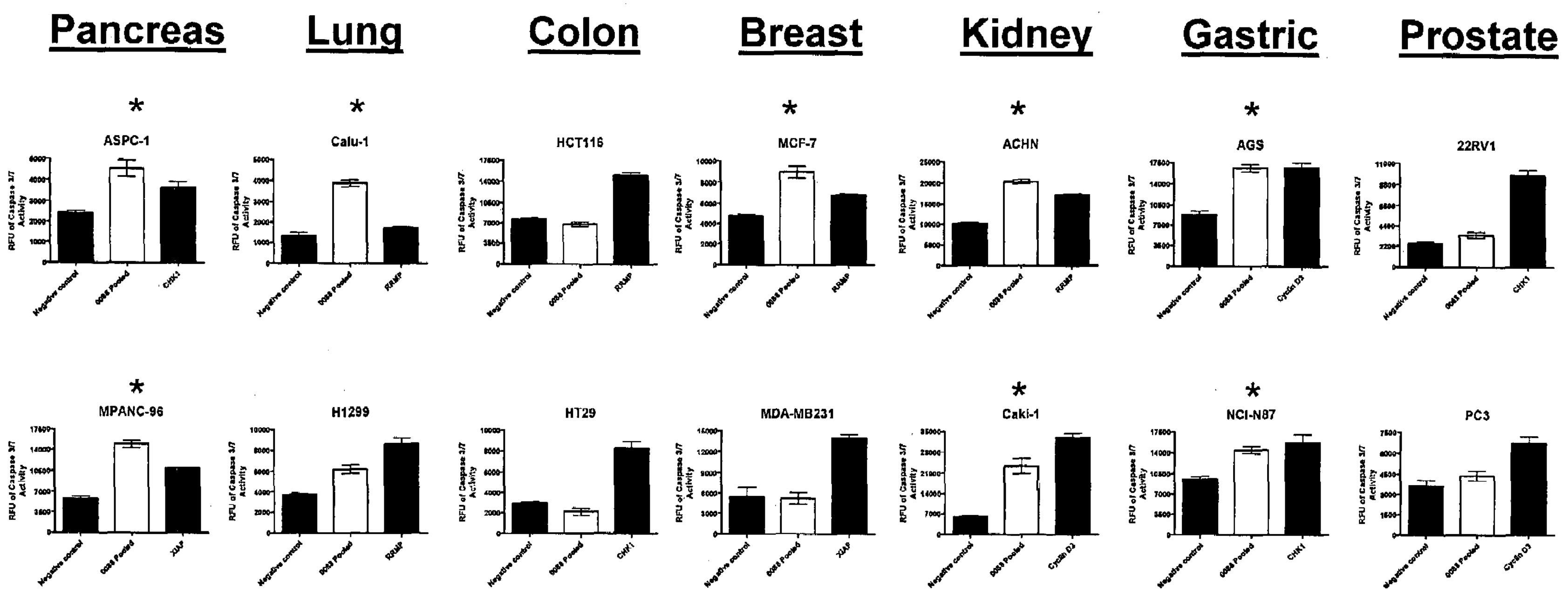

FIG. 142. RNAi Knockdown of Na-K ATPase β3 mRNA Induces Apoptosis in Pancreatic, Lung, Breast, Kidney and Gastric Cancer Cells.

Figure 143:
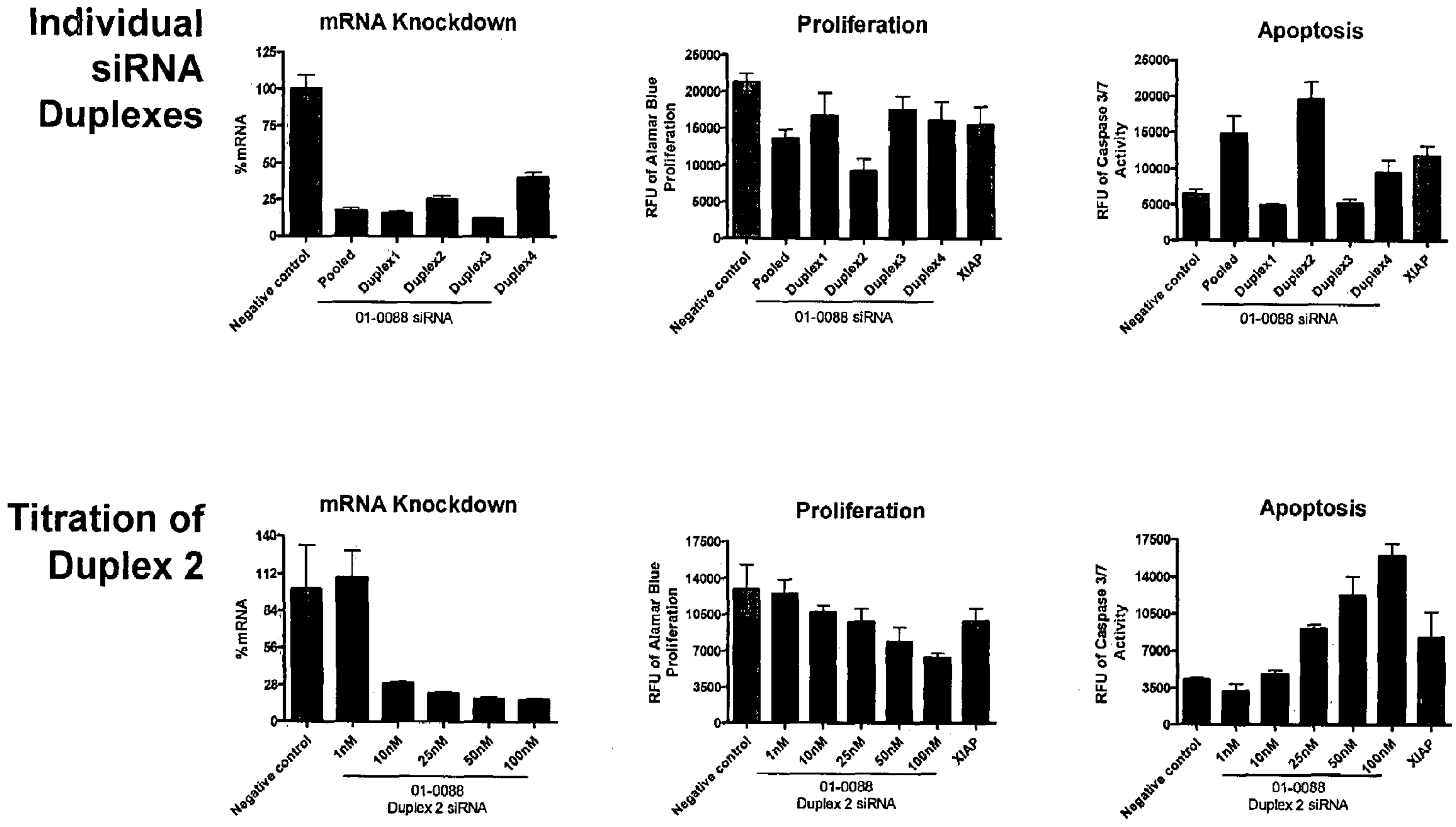

FIG. 143. RNAi Knockdown of Na-K ATPase β3 mRNA Inhibit Proliferation and Induces Apoptosis in MPANC-96 Pancreatic Cancer Cells.

Figure 144:
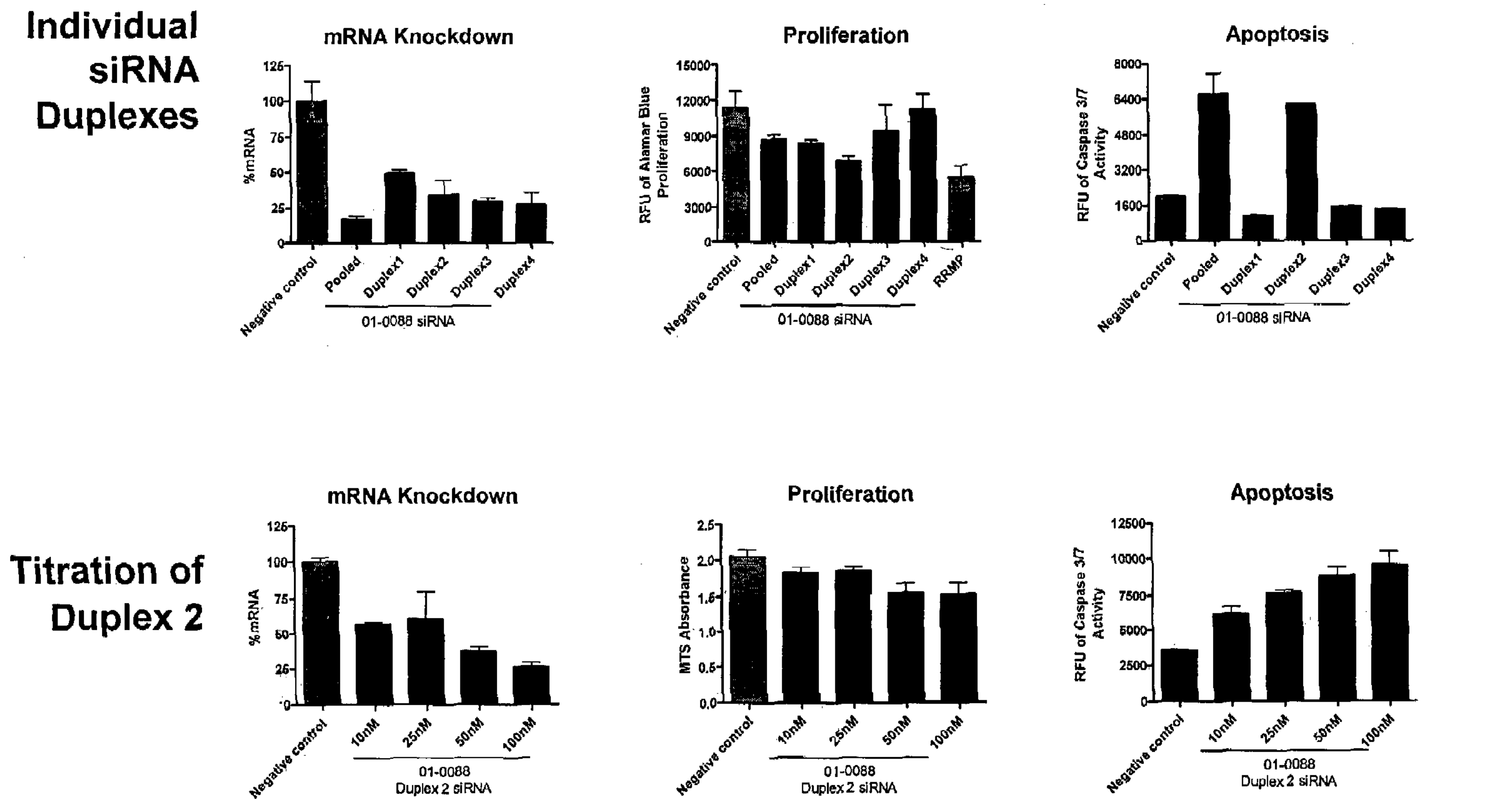

FIG. 144. RNAi Knockdown of Na-K ATPase β3 mRNA Inhibit Proliferation and Induces Apoptosis in ASPC-1 Pancreatic Cancer Cells.

Figure 145:
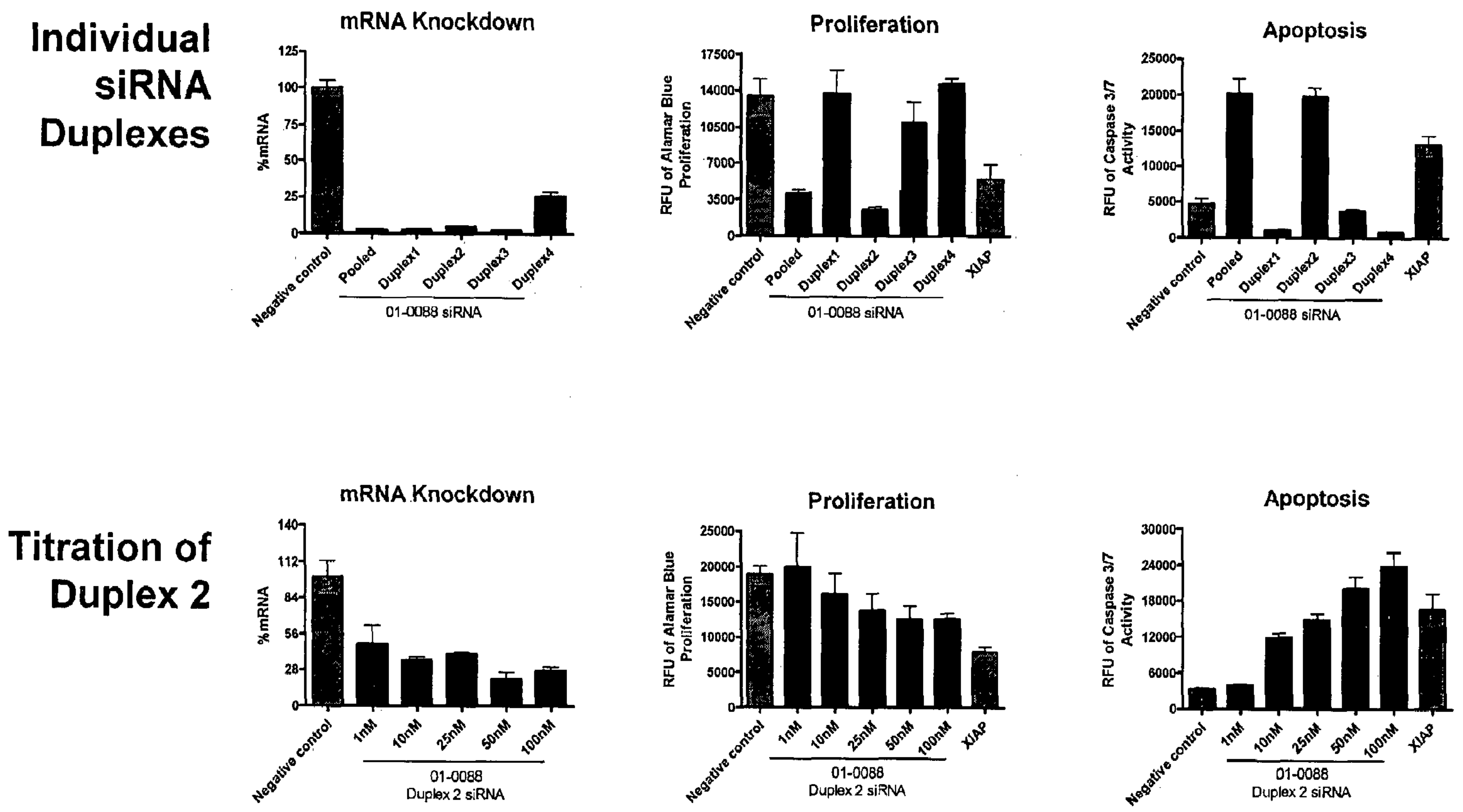

FIG. 145. RNAi Knockdown of Na-K ATPase β3 mRNA Inhibit Proliferation and Induces Apoptosis in Caki-1 Kidney Cancer Cells.

Figure 146:
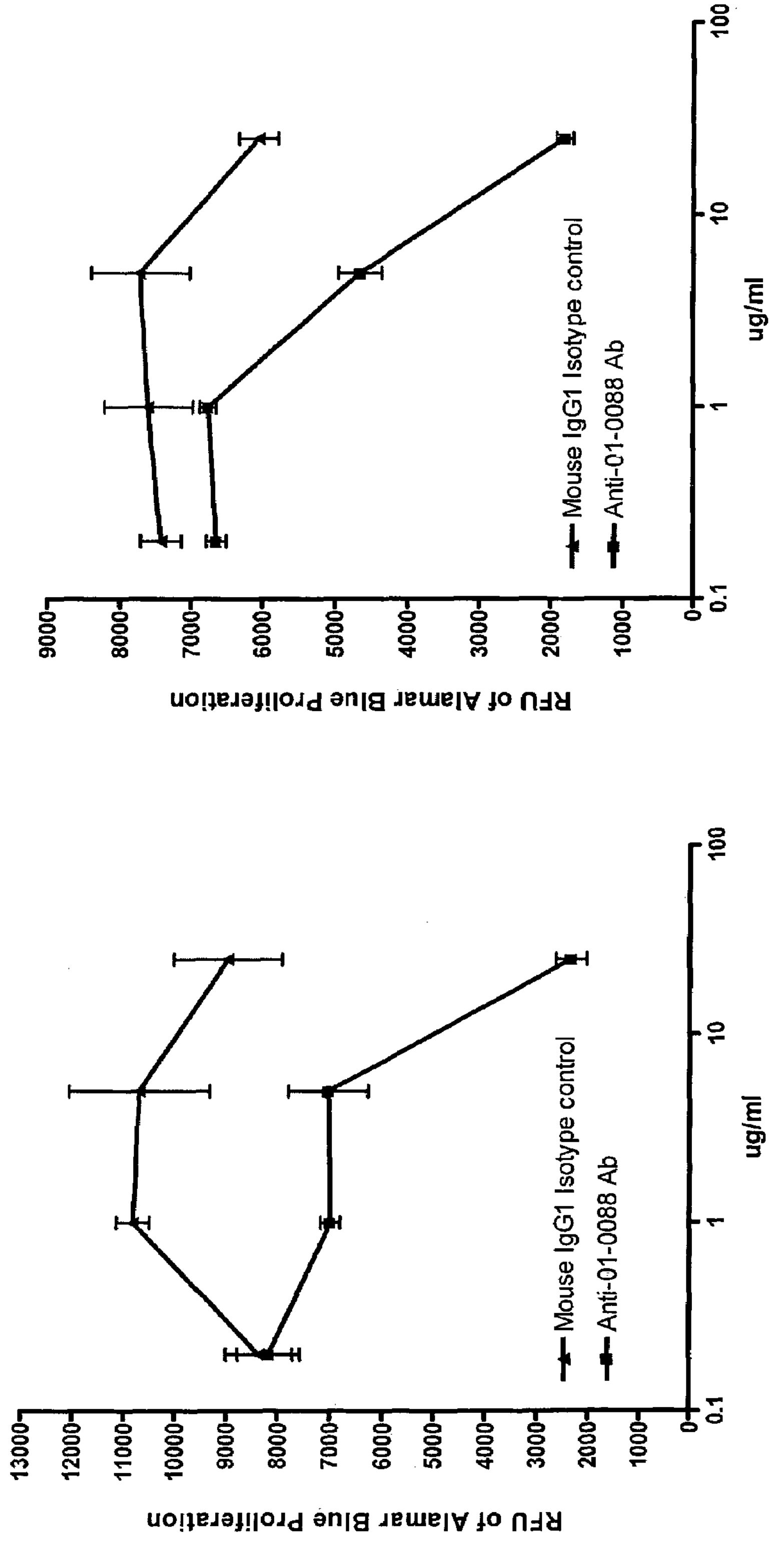

FIG. 146. Anti-Na-K ATPase β3 Antibody Inhibits Proliferation of ASPC-1 and BXPC-3 Pancreatic Cancer Cells.

Figure 147:
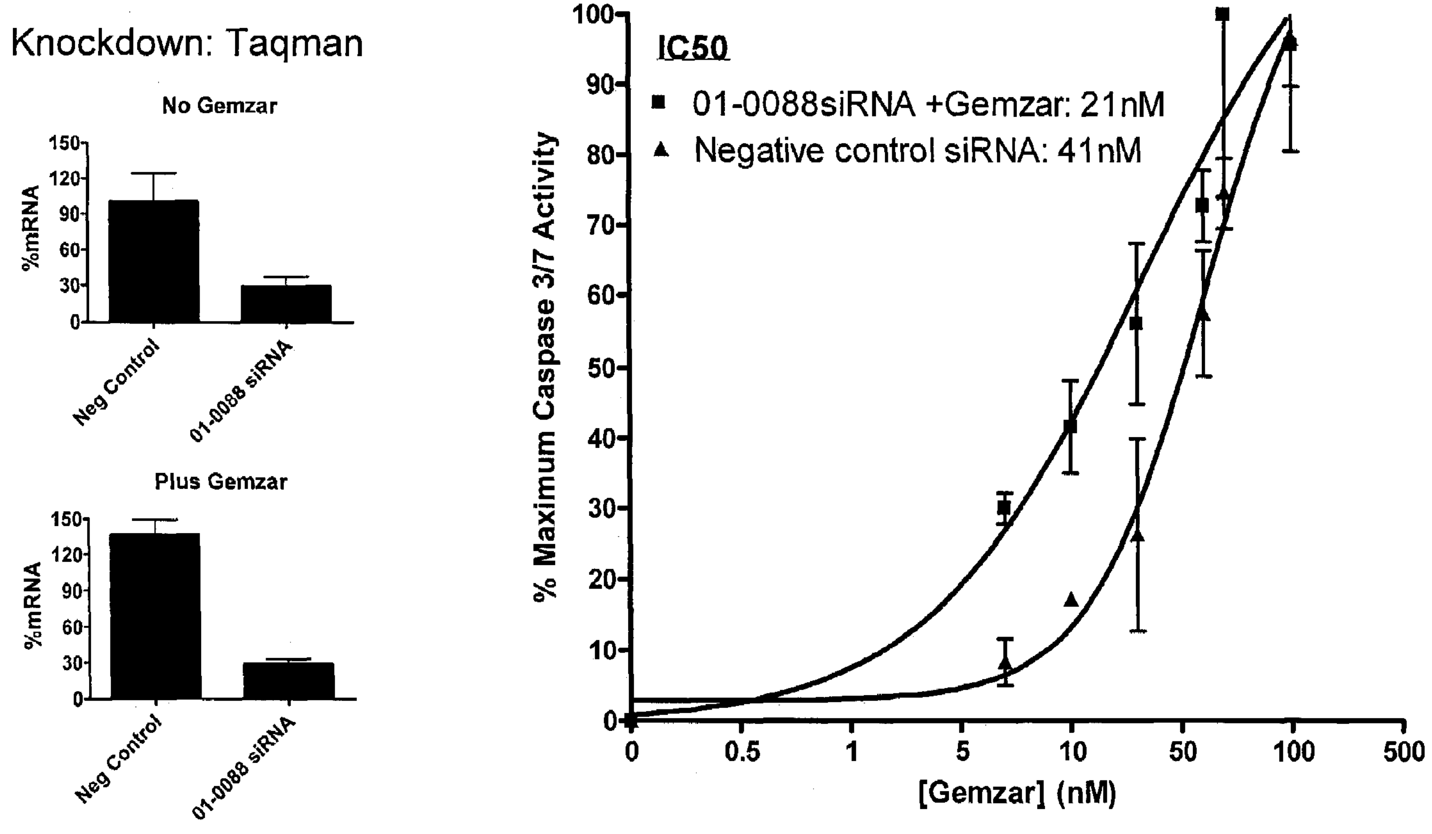

FIG. 147. Na-K ATPase β3 siRNA in Combination with Gemzar Increases Apoptosis of BXPC-3 Pancreatic Cancer Cells.

FIG. 148. mRNA sequence of Na/K ATPase beta 3, indicating siRNA target regions.

VIPR1

FIG. 149. VIPR1 is Over-expressed in Multiple Tumor Types.

Figure 150:
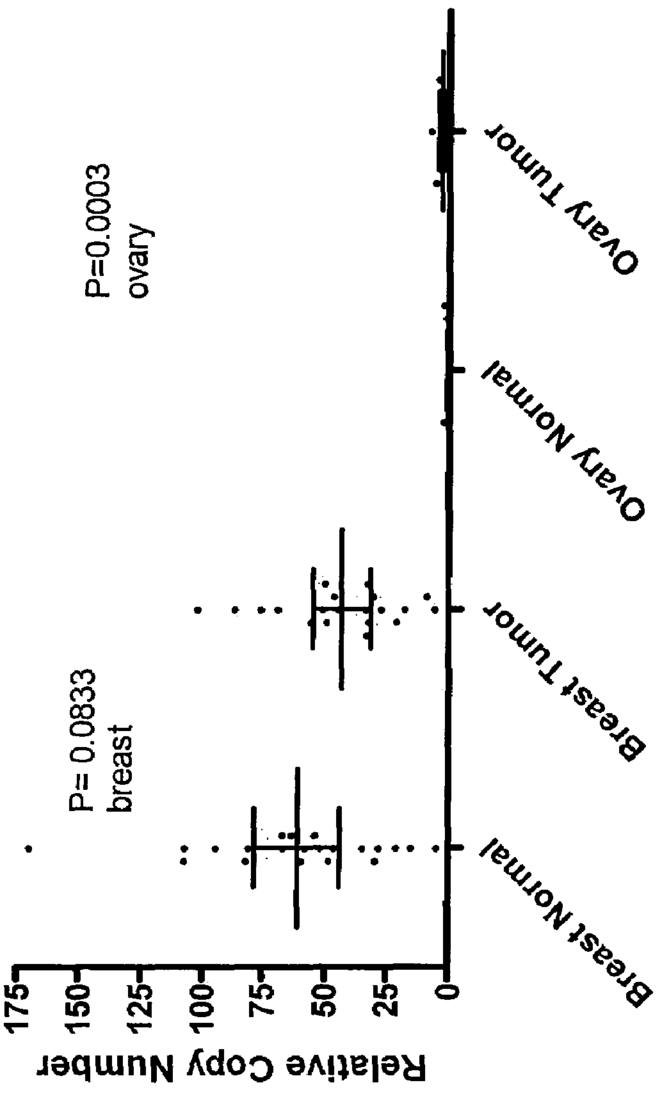

FIG. 150. VIPR1 mRNA Expression in Breast and Ovarian Tumors and Normal Tissues.

Figure 151:
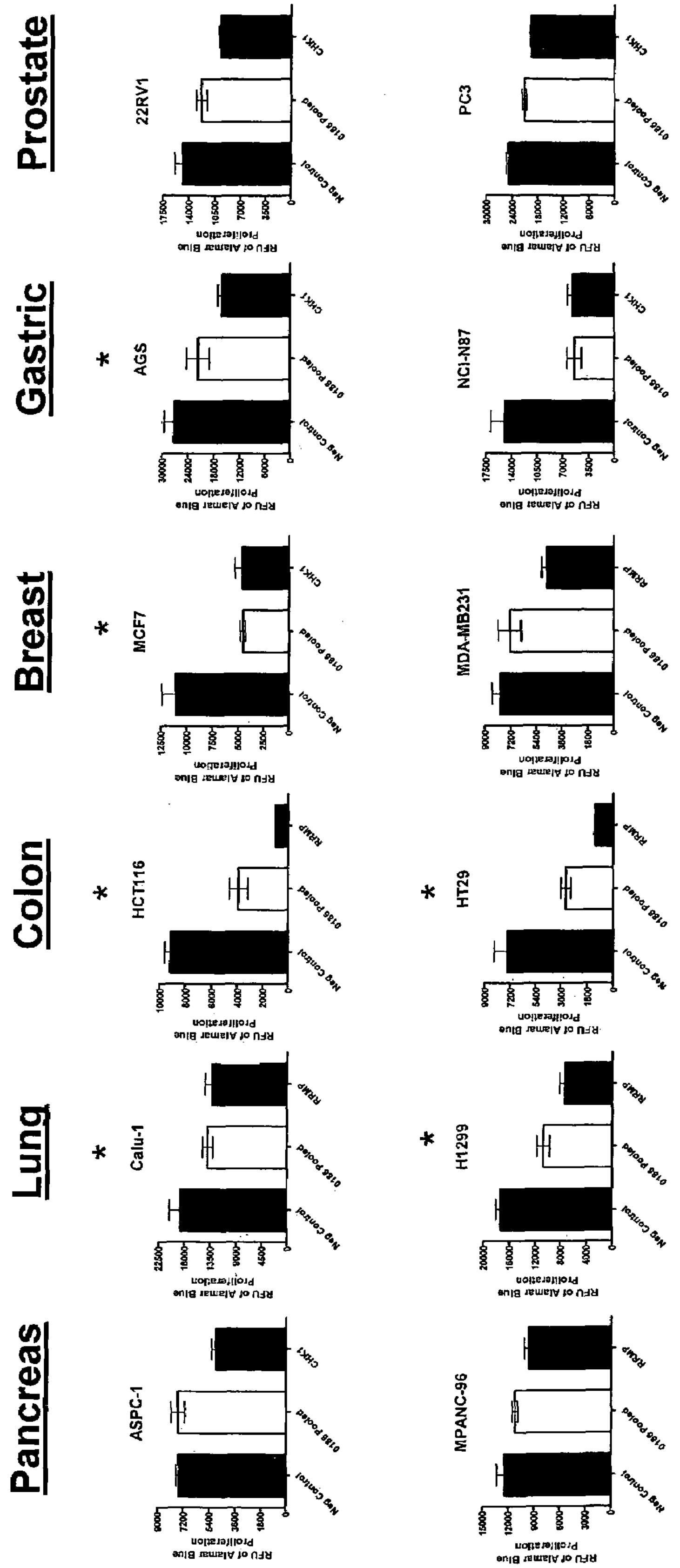

FIG. 151. VIPR1 siRNA Screen Data—Anti-Proliferation Activity.

Figure 152:
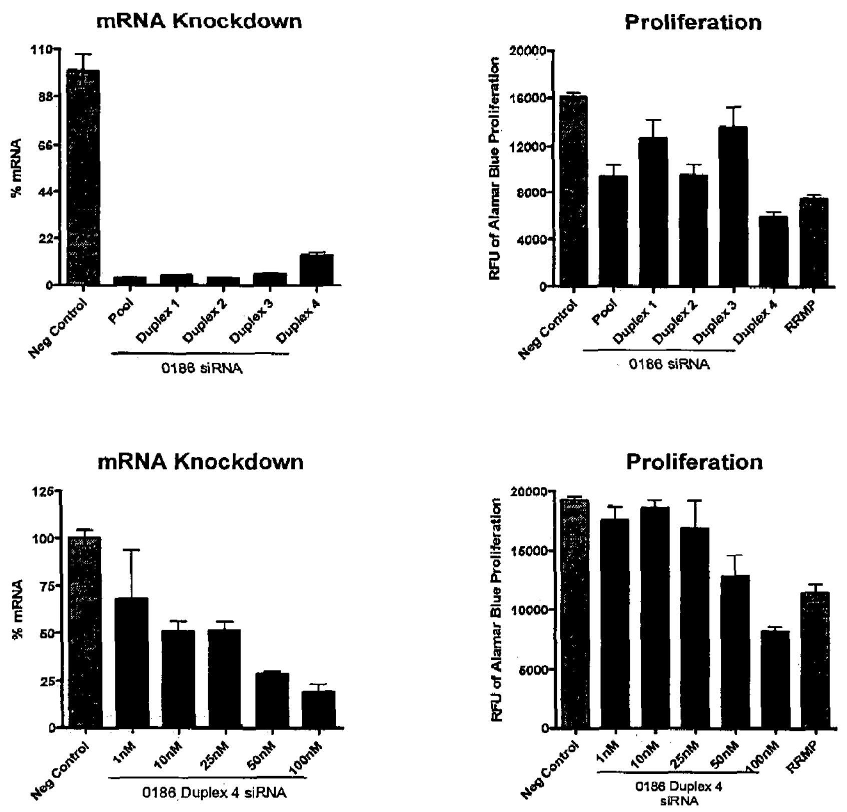

FIG. 152. VIPR1 Individual siRNA Duplex Data—Anti-Proliferation Activity—H11299 Lung Carcinoma.

Figure 153:
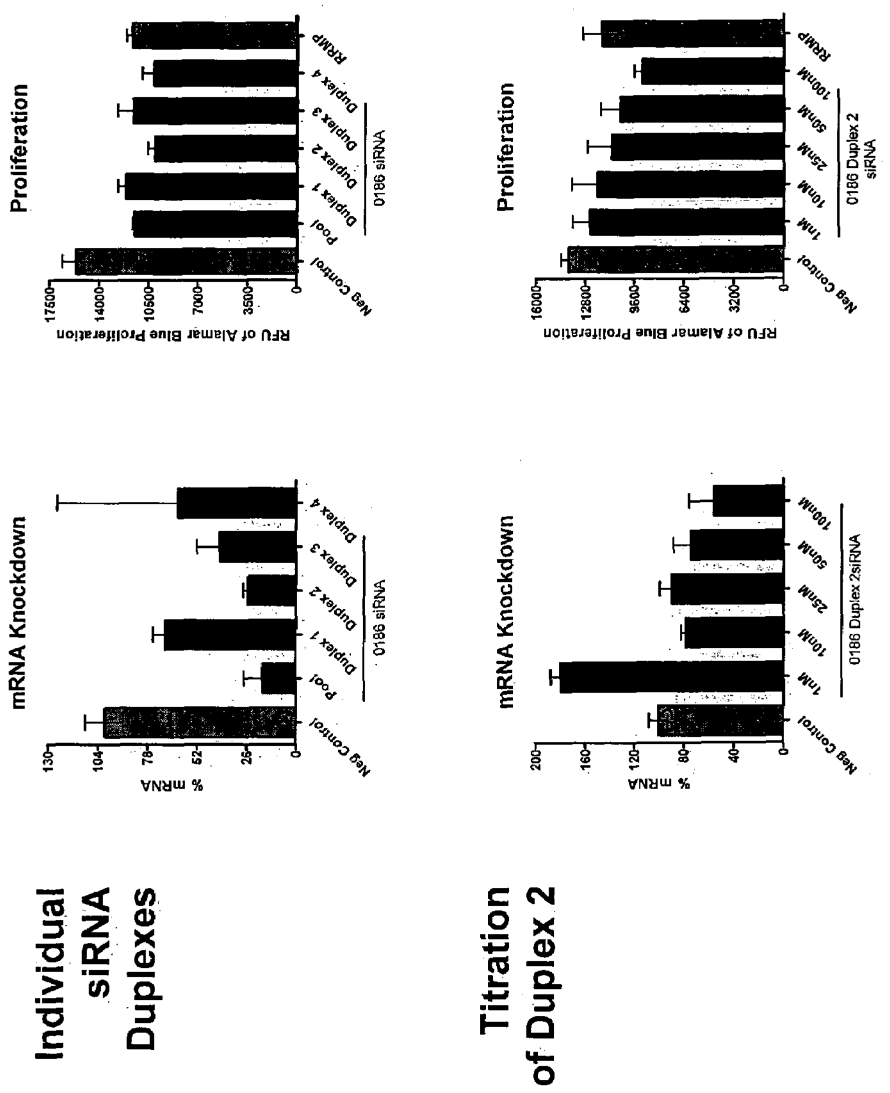

FIG. 153. VIPR1 Individual siRNA Duplex Data—Anti-Proliferation Activity—Calu-1 Lung Carcinoma.

Figure 154:
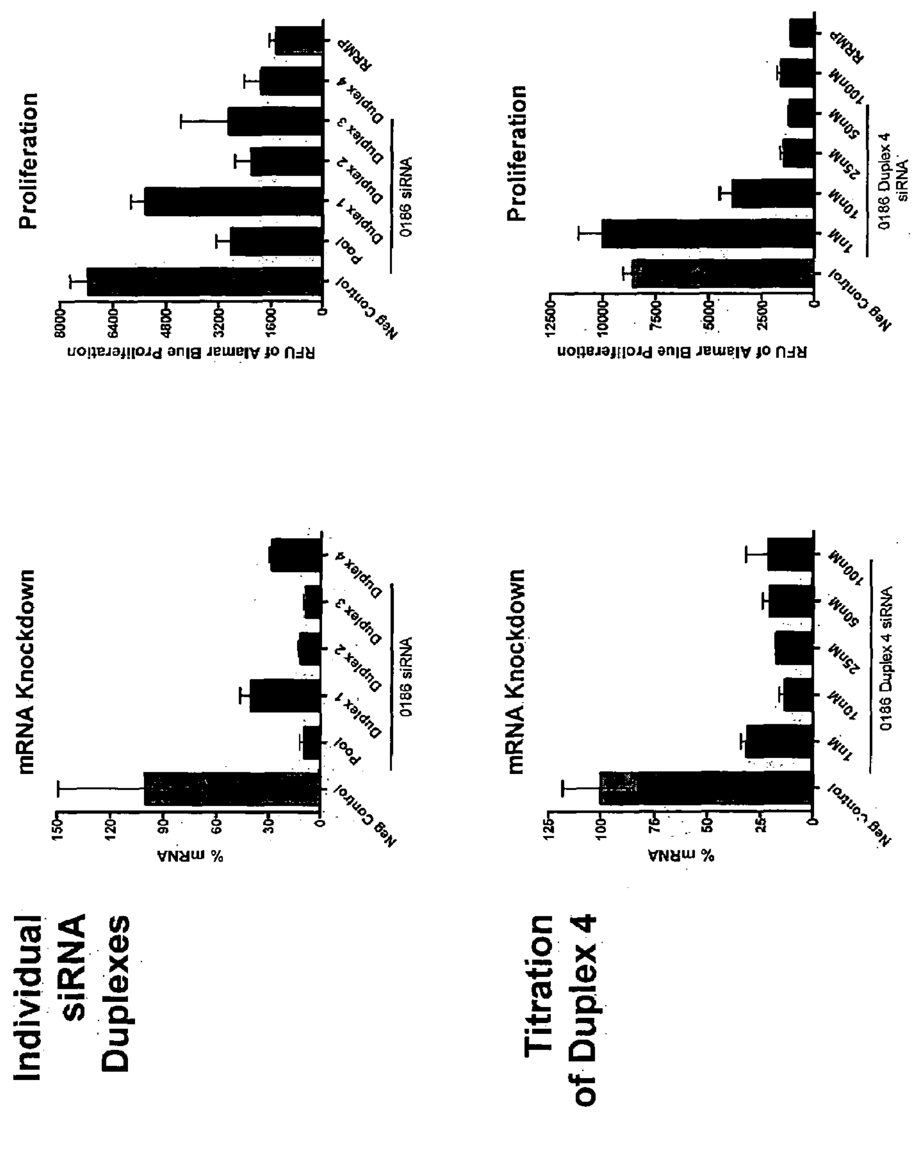

FIG. 154. VIPR1 (0186) Individual siRNA Duplex Data—Anti-Proliferation Activity —HCT116 Colon Carcinoma.

Figure 155:
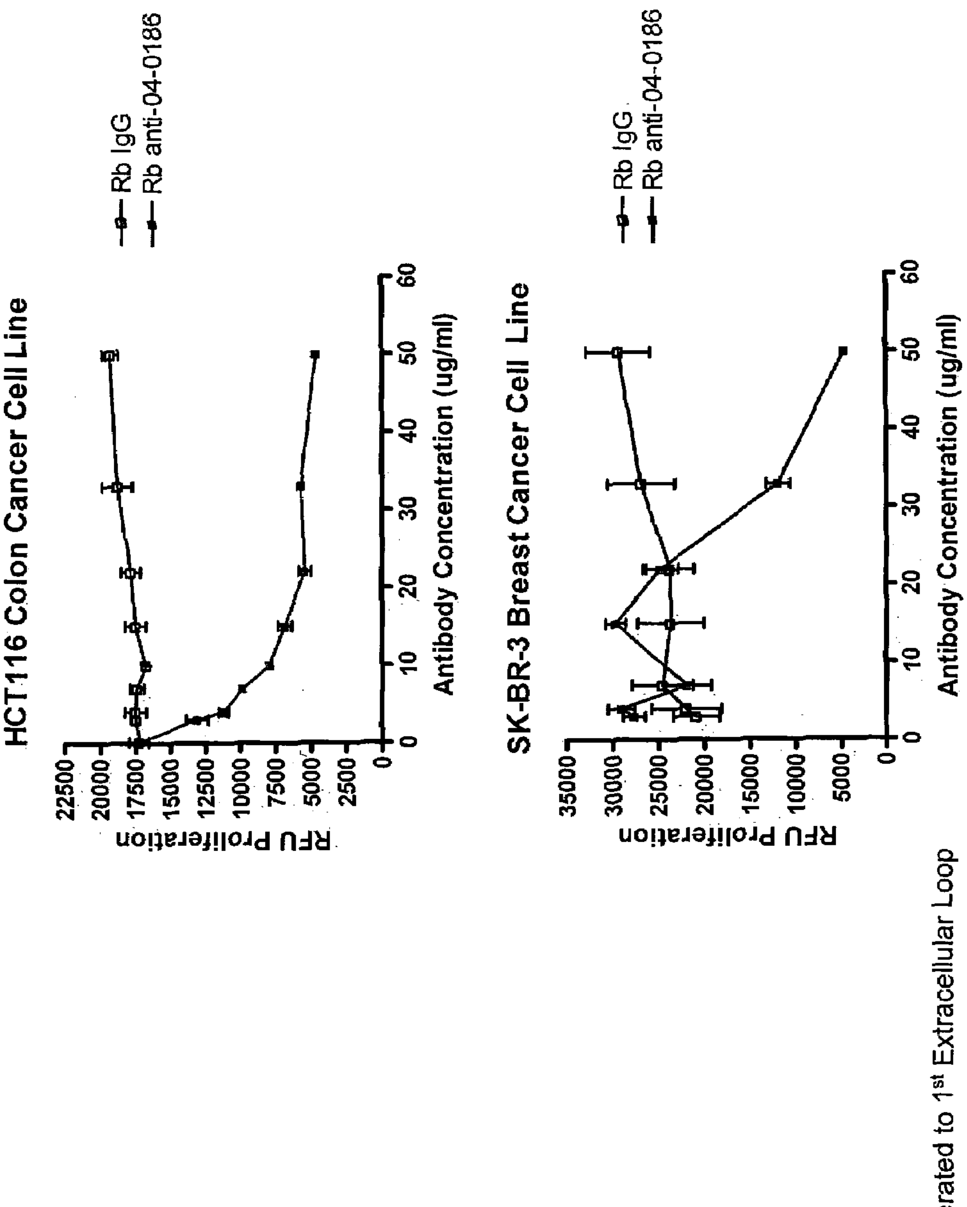

FIG. 155. Polyclonal Antibody to VIPR1 (04-0186) Inhibits Proliferation in Colon and Breast Cancer Cells.

FIG. 156. mRNA sequence of VIPR1, indicating siRNA target regions.

CD26

FIG. 157. CD26 is Over-Expressed in Multiple Tumor Types.

Figure 158:
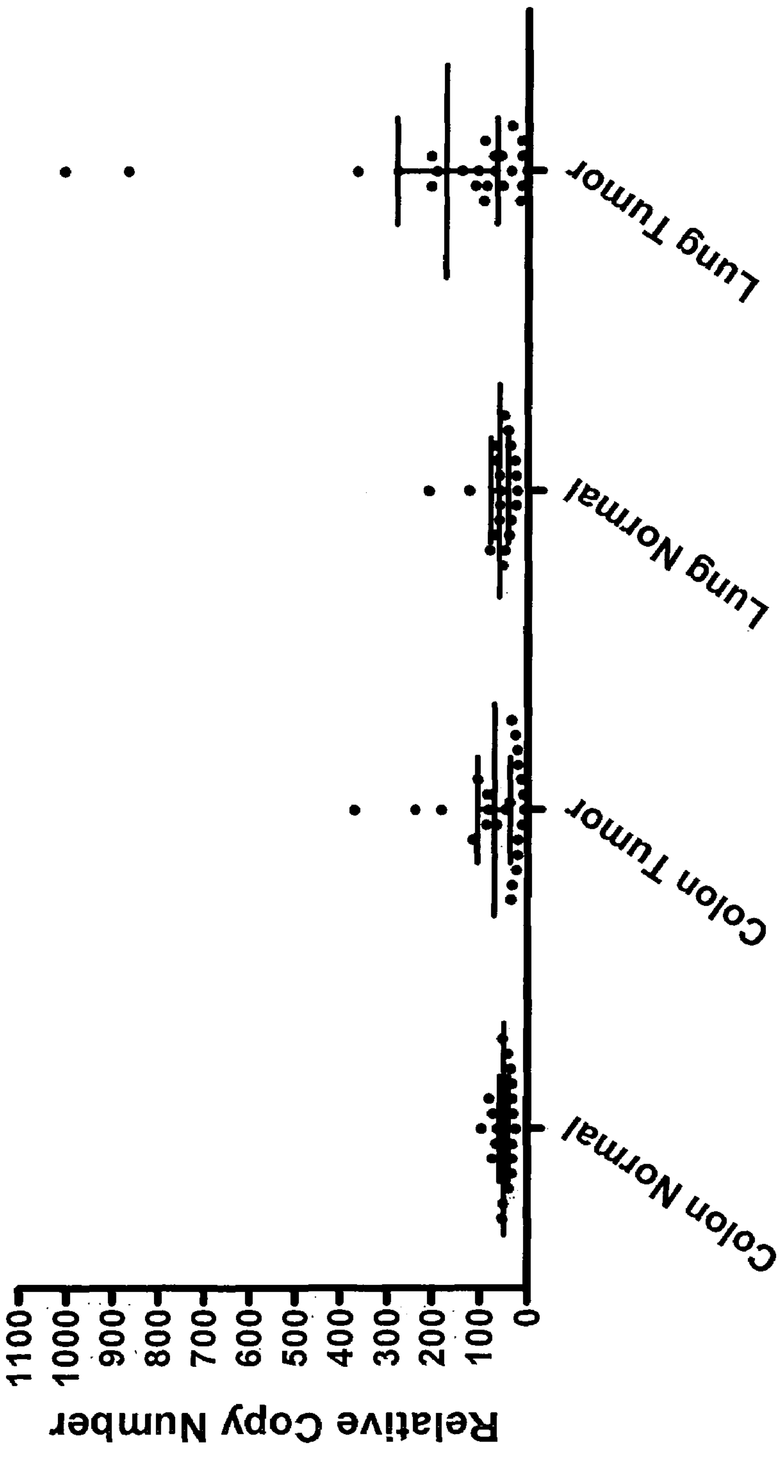

FIG. 158. CD26 mRNA Expression Analysis in Lung and Colon Tumor Tissues.

Figure 159:
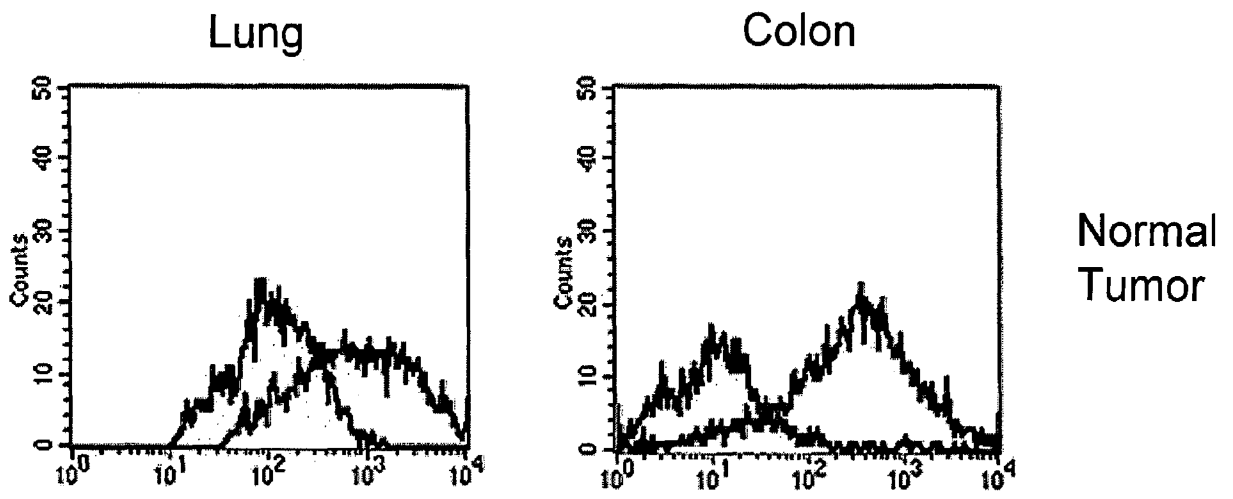

FIG. 159. CD26 QFACS Over-expression in Lung and Colon Tumors.

Figure 160:
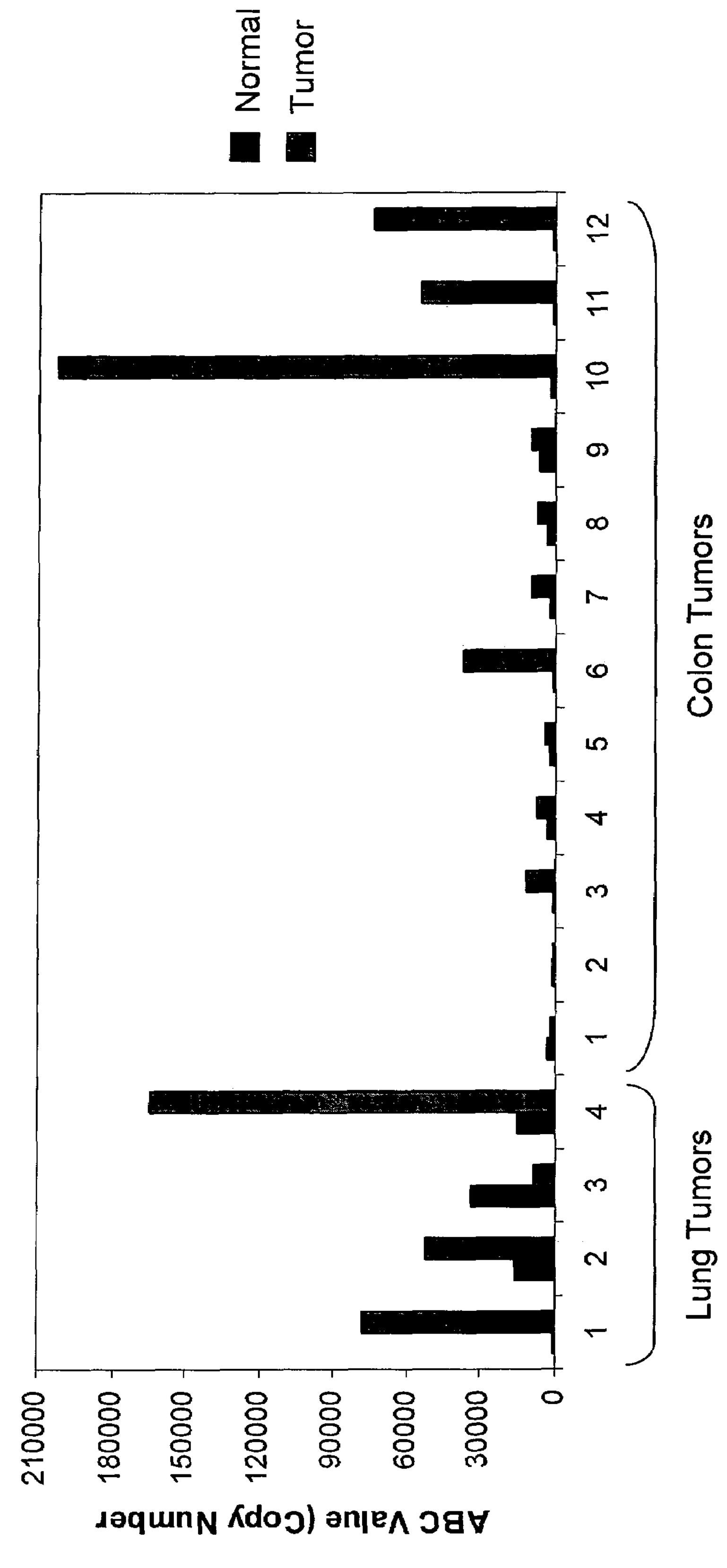

FIG. 160. CD26 QFACS Over-expression in Lung and Colon Tumors.

Figure 161:
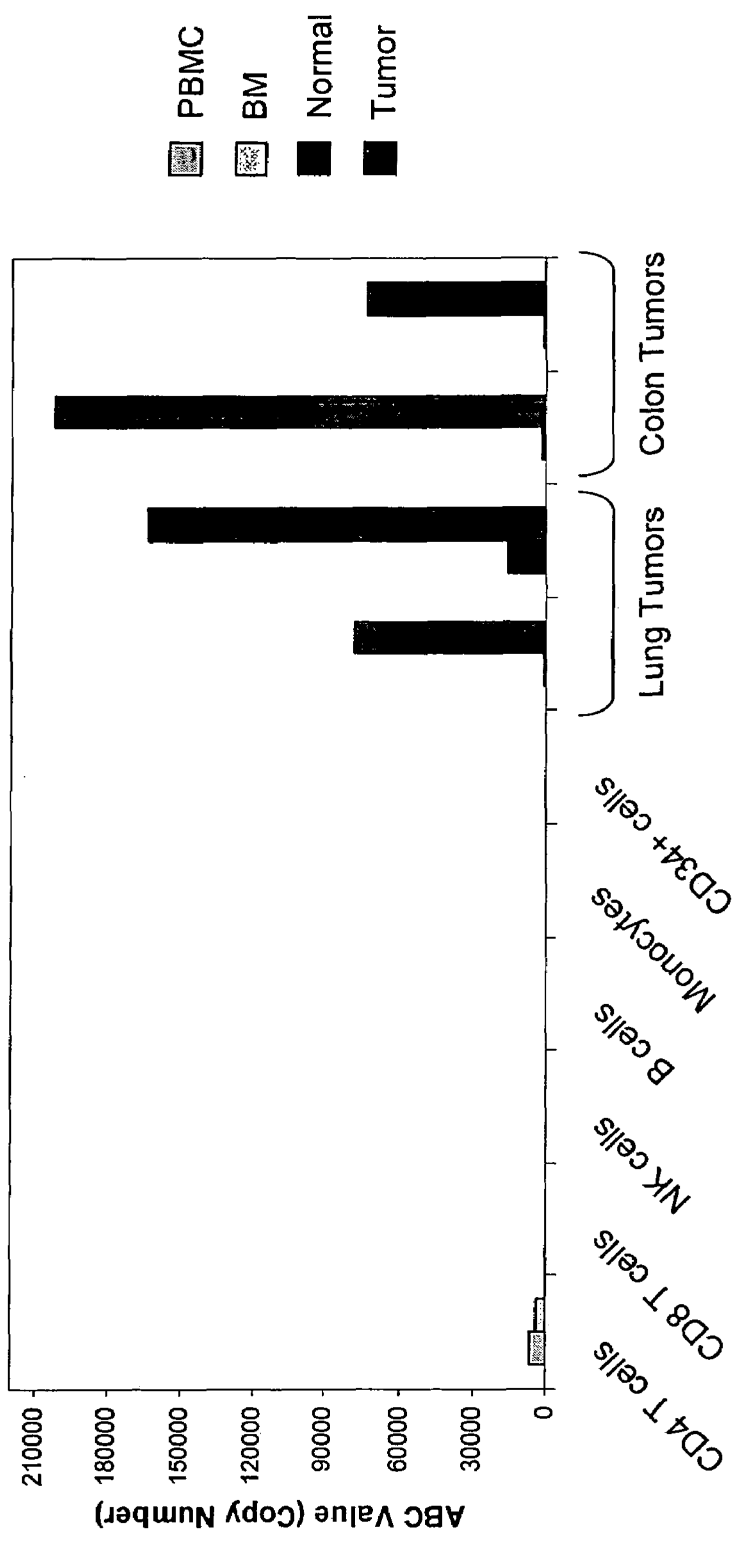

FIG. 161. CD26 QFACS Reveals Low Expression in Blood and Bone Marrow.

Figure 162:
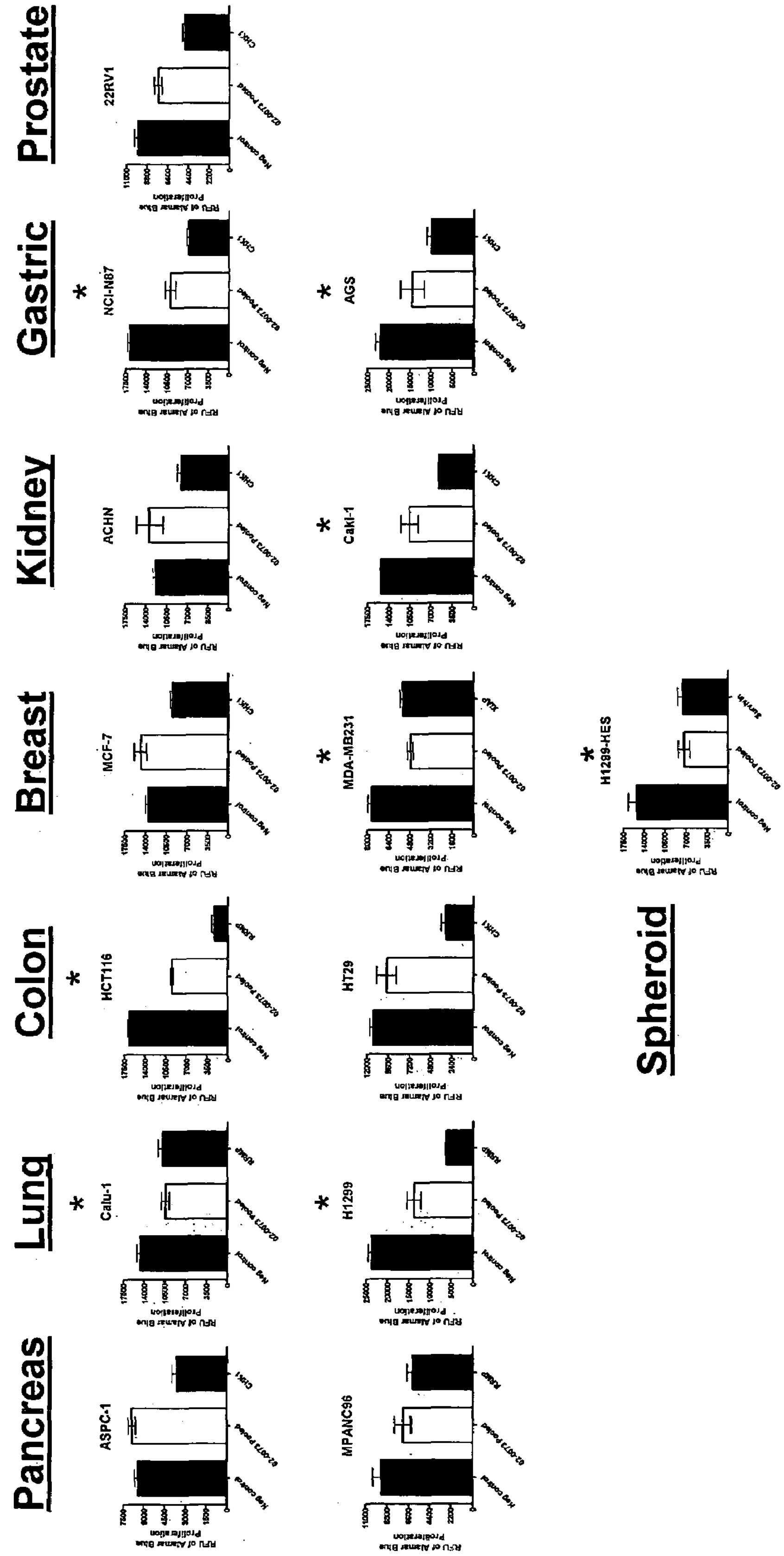

FIG. 162. Knockdown of CD26 mRNA Inhibits Proliferation in Lung, Gastric, Colon, Breast, Kidney, Gastric and Spheroid Cancer Cells.

Figure 163:
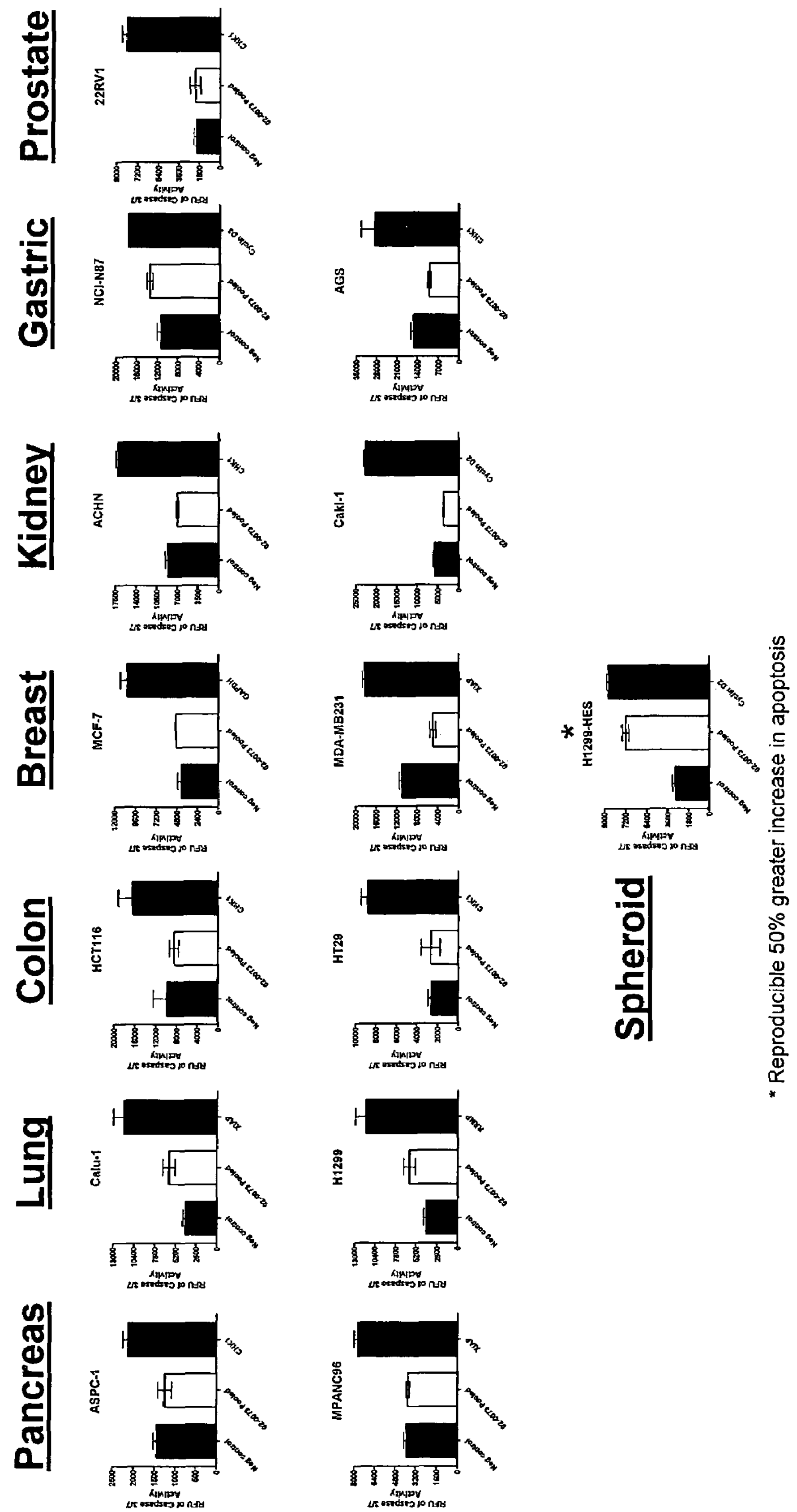

FIG. 163. Knockdown of CD26 mRNA Induces Apoptosis in Spheroid Cancer Cells.

Figure 164:
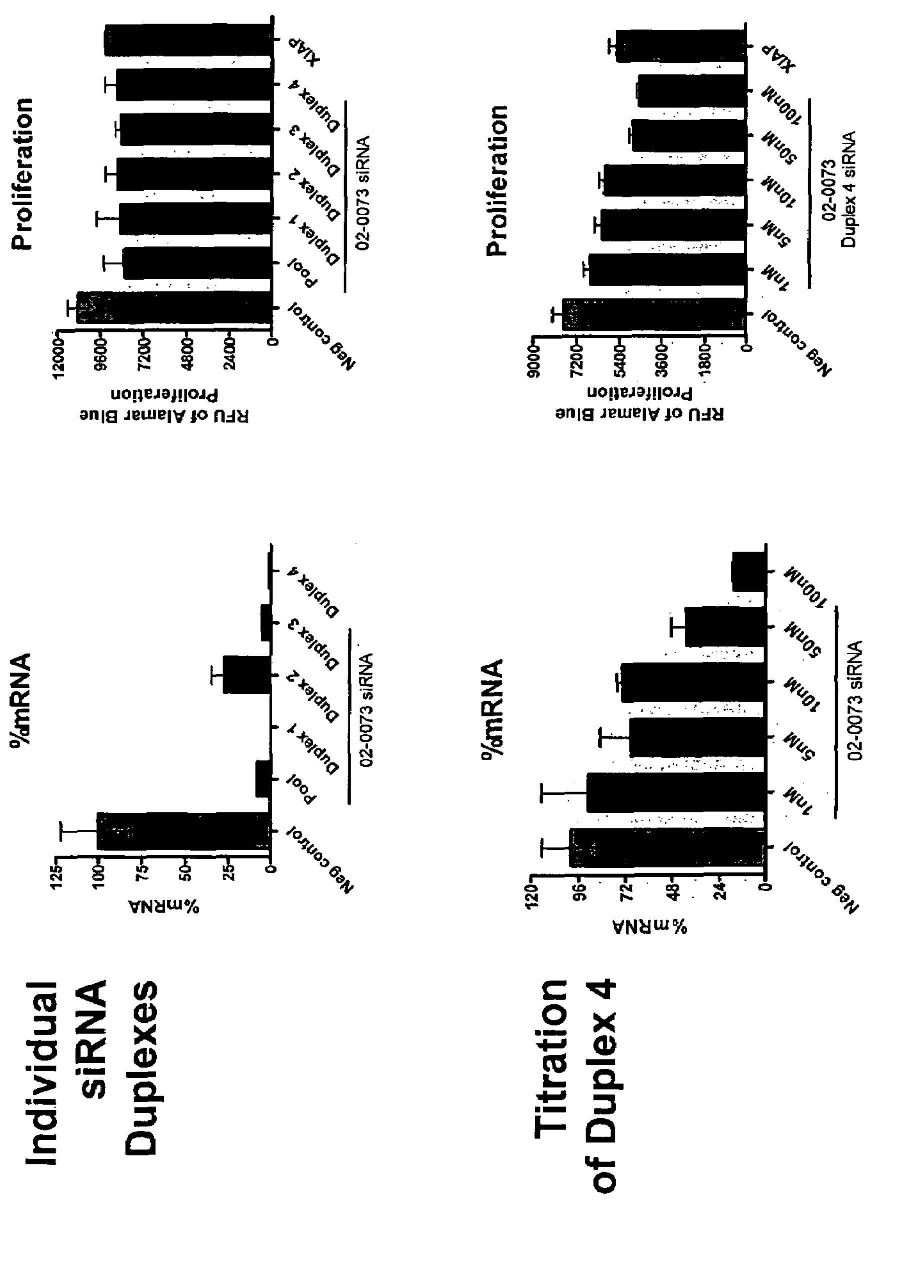

FIG. 164. Knockdown of CD26 mRNA Inhibits Proliferation of Calu-1 Lung Cancer Cells.

Figure 165:
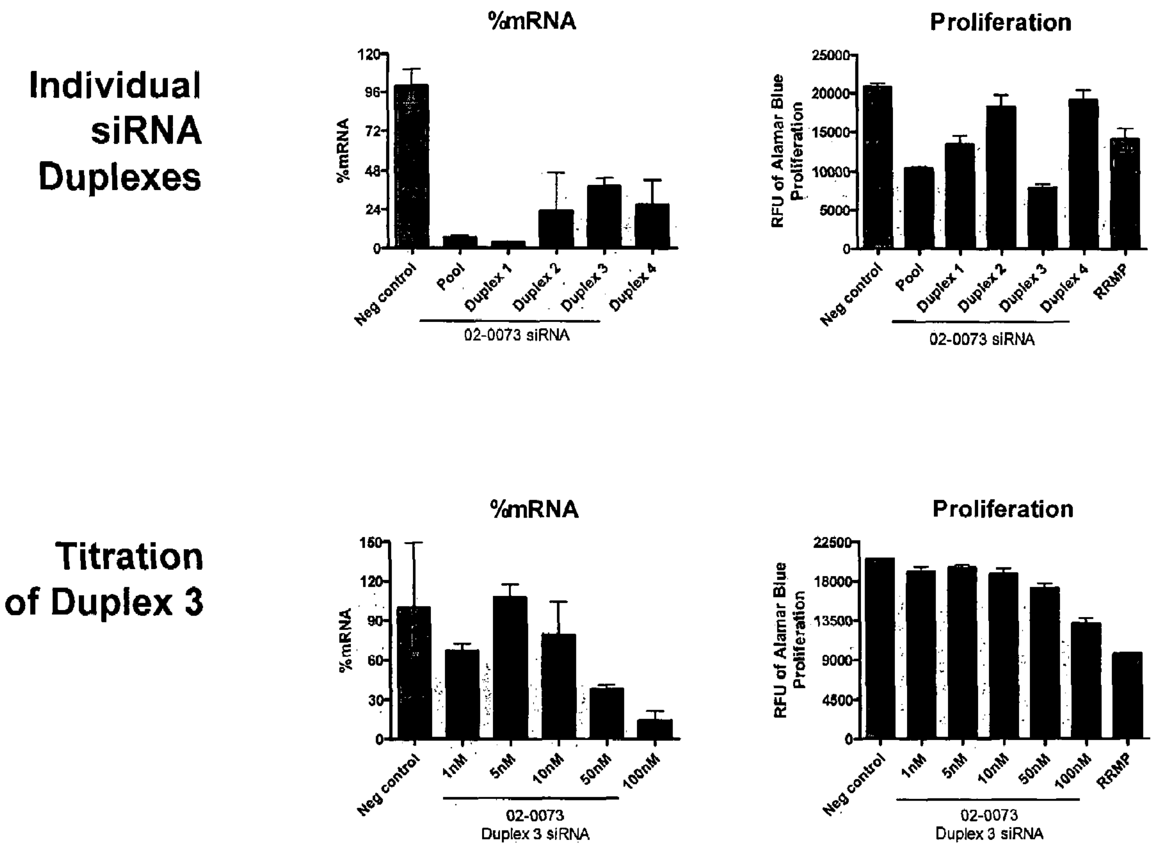

FIG. 165. Knockdown of CD26 Inhibits Proliferation in H1299 Lung Cancer Cells.

Figure 166:
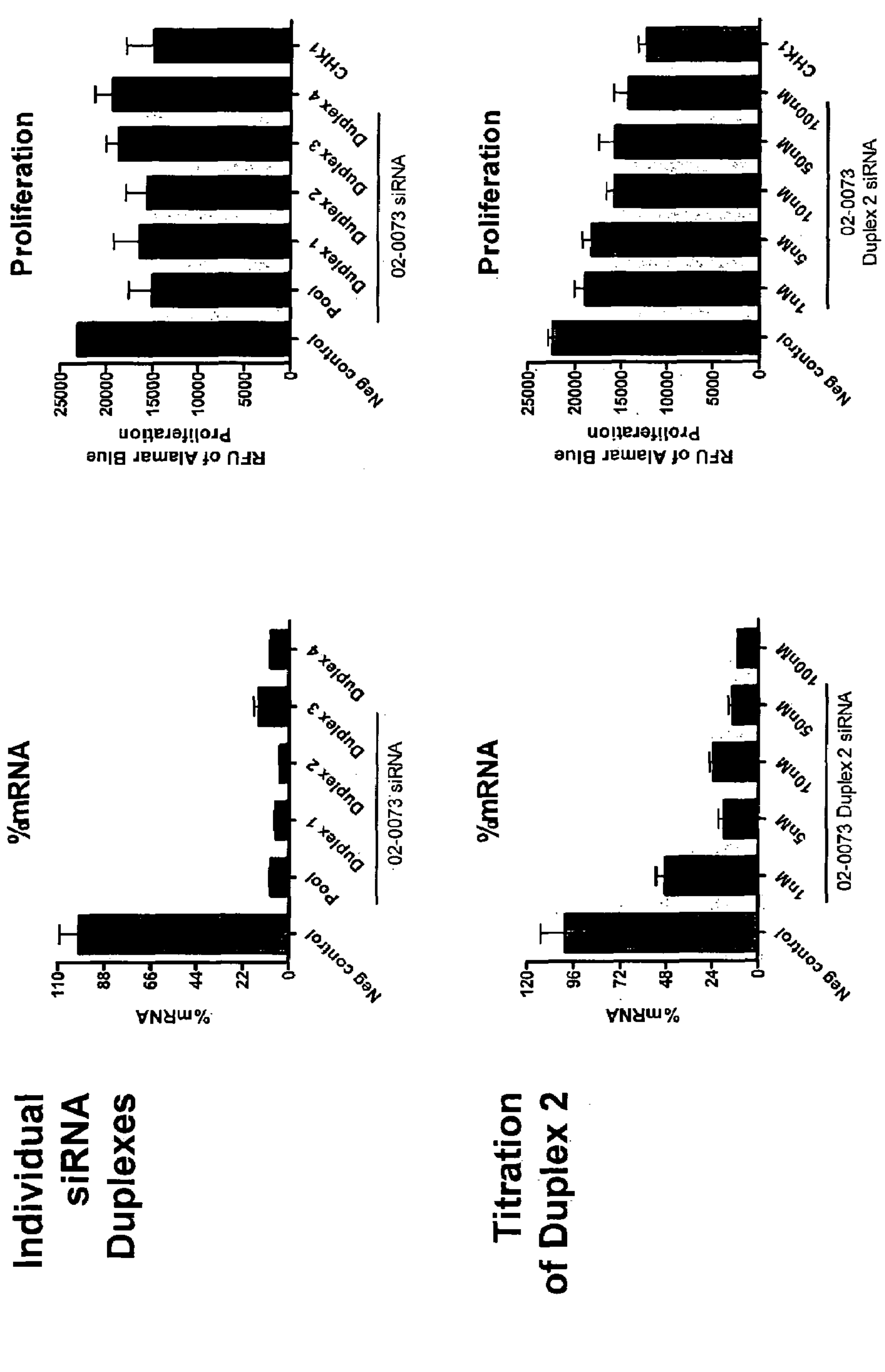

FIG. 166. Knockdown of CD26 Inhibits Proliferation in Caki-1 Kidney Cancer Cells.

Figure 167:
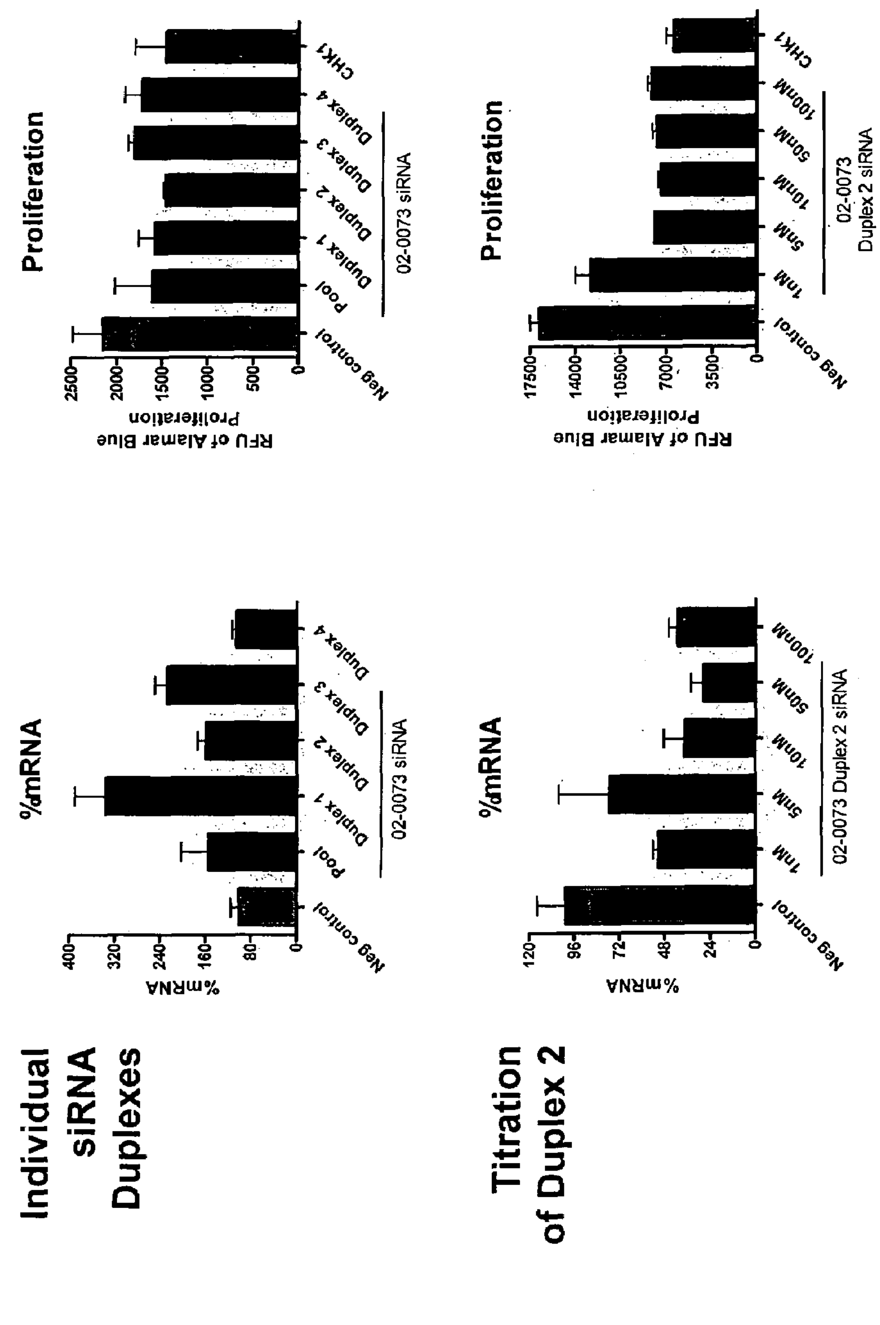

FIG. 167. Knockdown of CD26 Inhibits Proliferation in NCI-N87 Gastric Cancer Cells.

FIG. 168. Knockdown of CD26 Inhibits Proliferation and Induces Apoptosis in H1299-HES Spheroid Cancer Cells.

Figure 169:
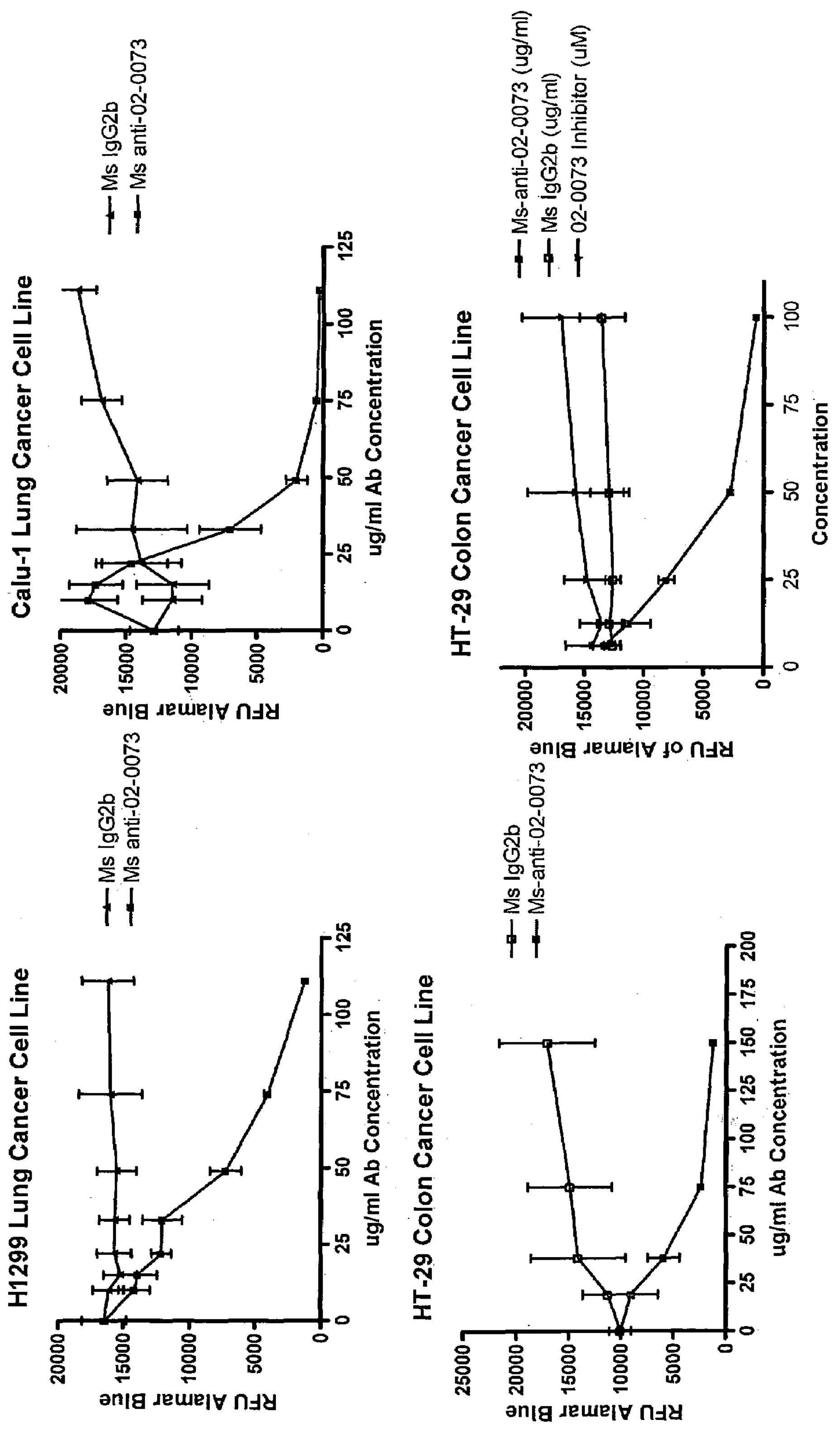

FIG. 169. Monoclonal Antibody to CD26 Inhibits Proliferation in Lung and Colon Cancer Cells.

FIG. 170. mRNA sequence of CD26, indicating siRNA target regions.

CXADR

FIG. 171. CXADR is Overexpressed in Multiple Tumor Types.

Figure 172:
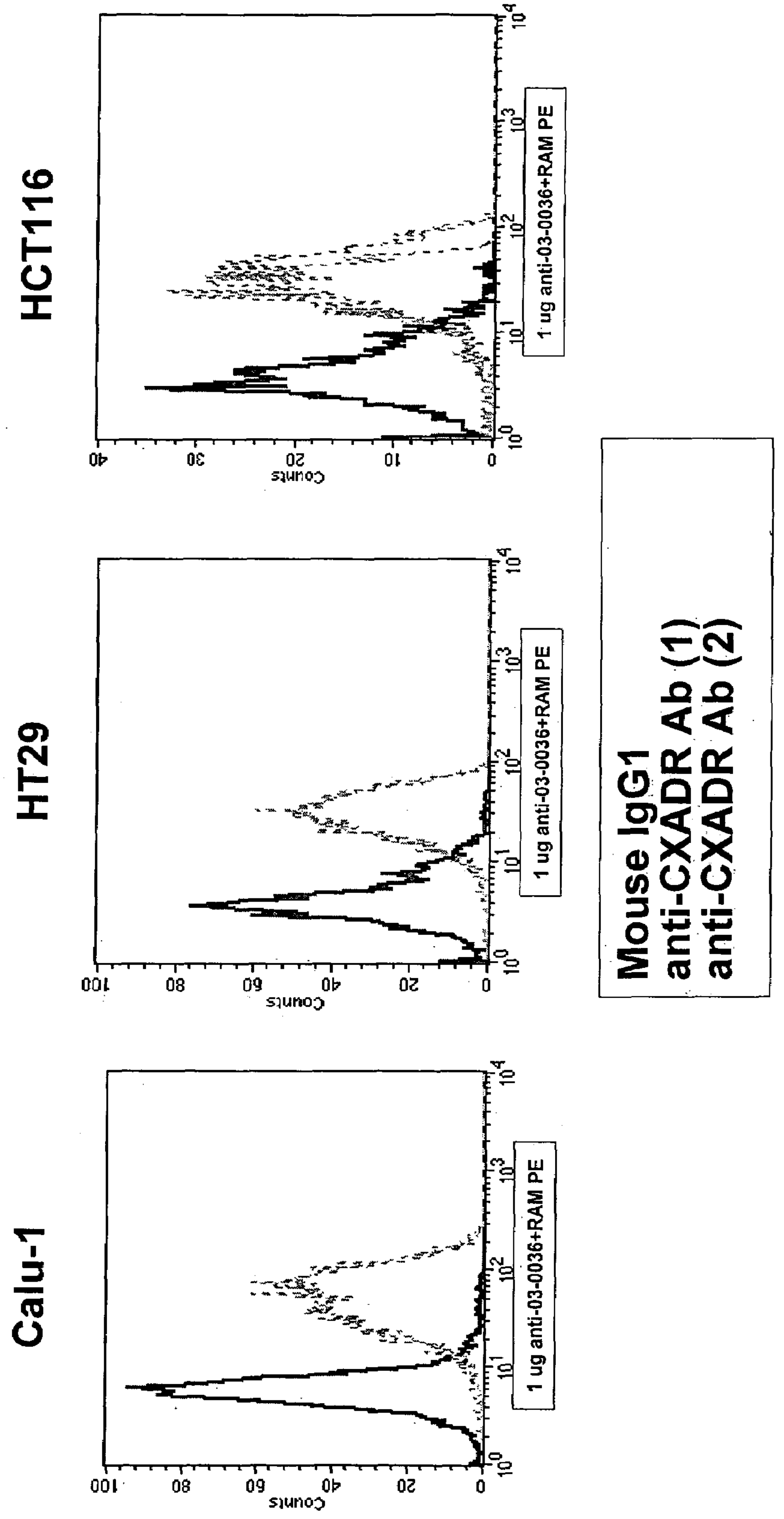

FIG. 172. CXADR Expression by FACS in Colon and Lung Cancer Cell Lines.

Figure 173:
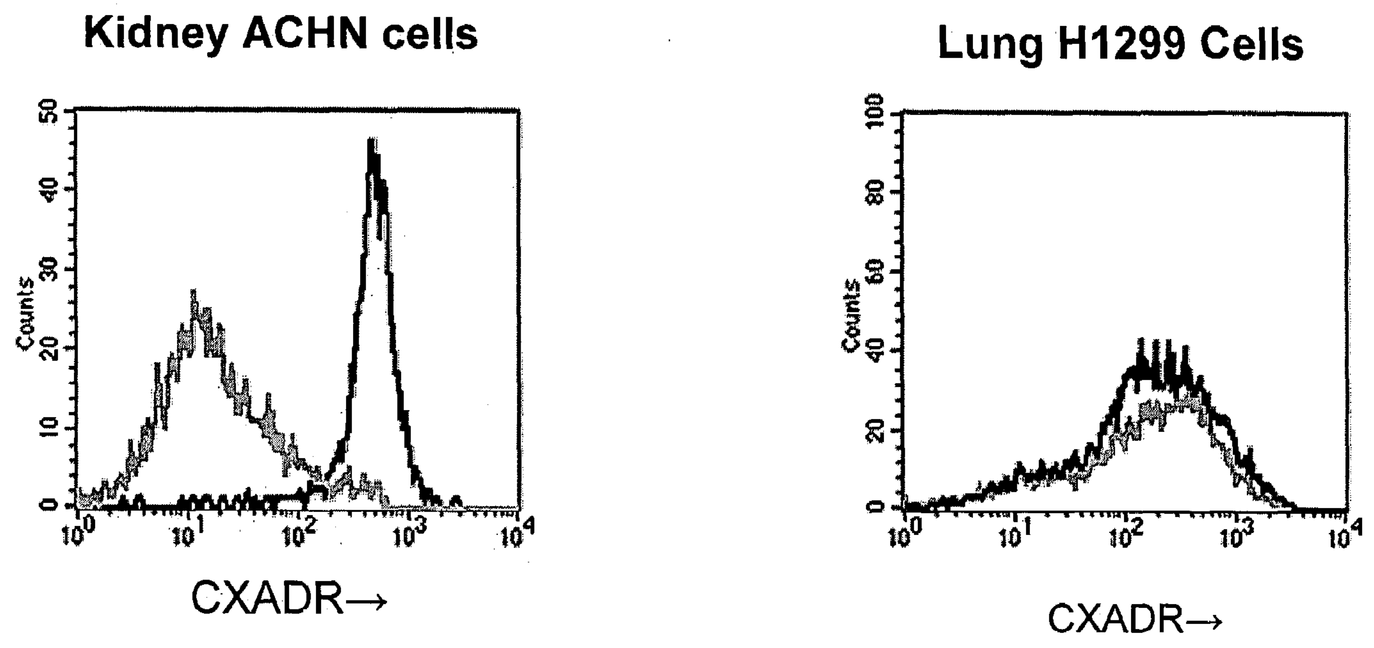

FIG. 173. CXADR Expression by FACS in 3D Spheroid Cells Derived from Kidney and Lung Cancer Cell Lines.

Figure 174:
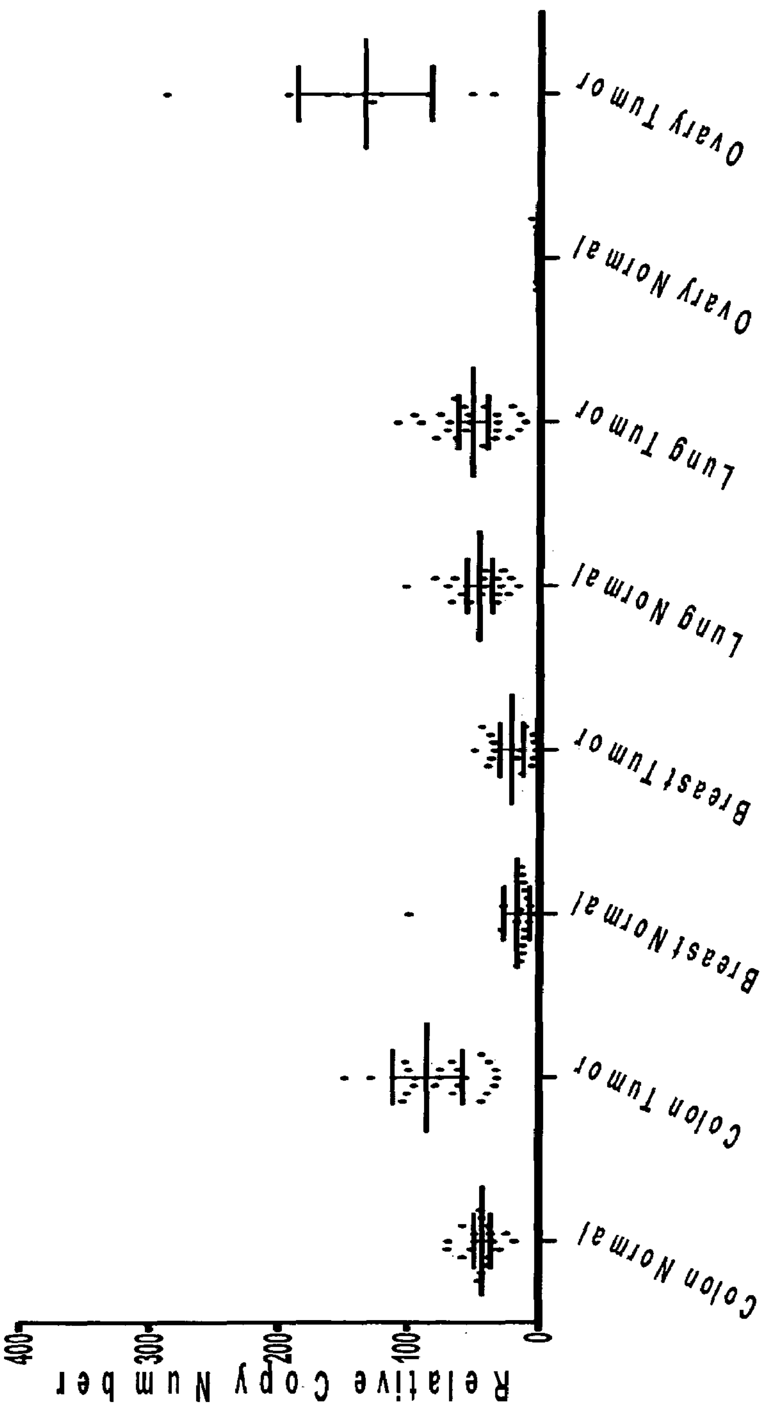

FIG. 174. CXADR mRNA Expression Analysis in Multiple Tumor Tissues.

Figure 175:
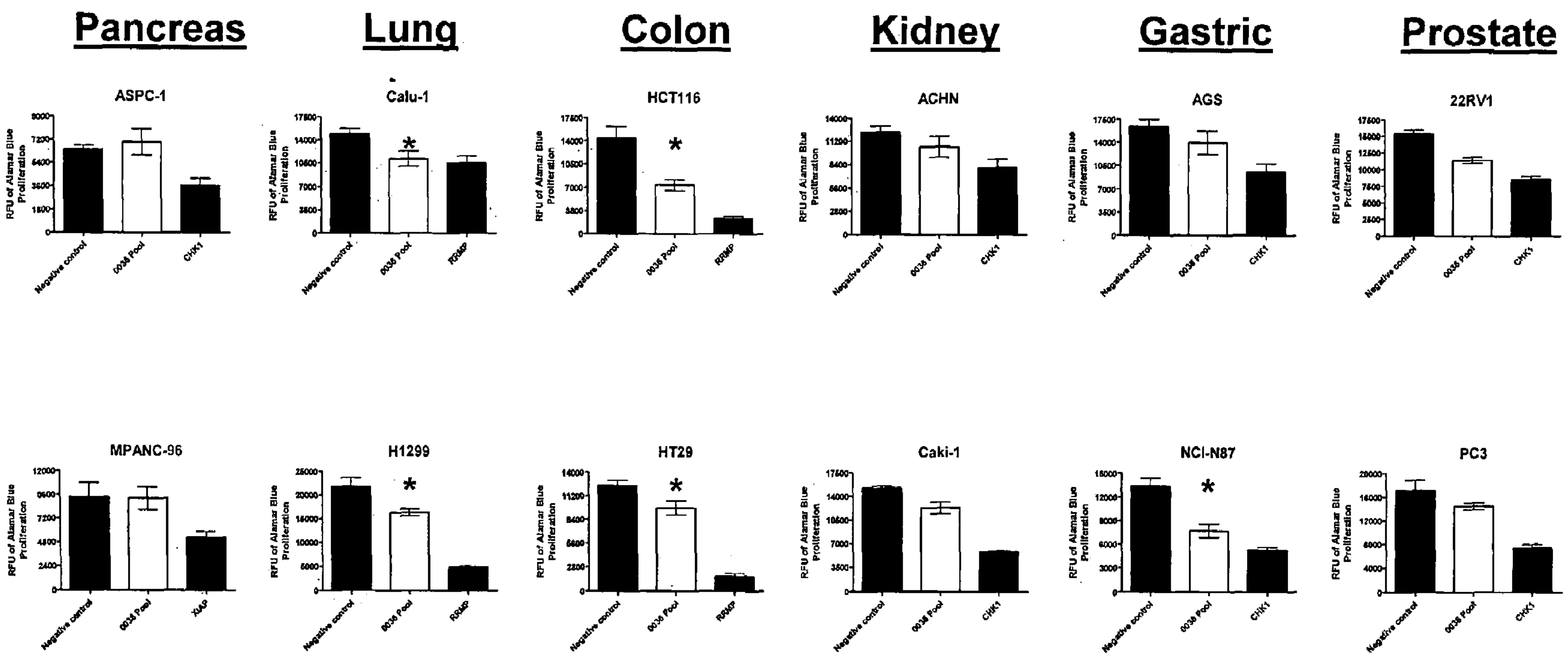

FIG. 175. Knockdown of CXADR mRNA Inhibits Proliferation in Lung, Colon and Gastric Cancer Cells.

Figure 176:
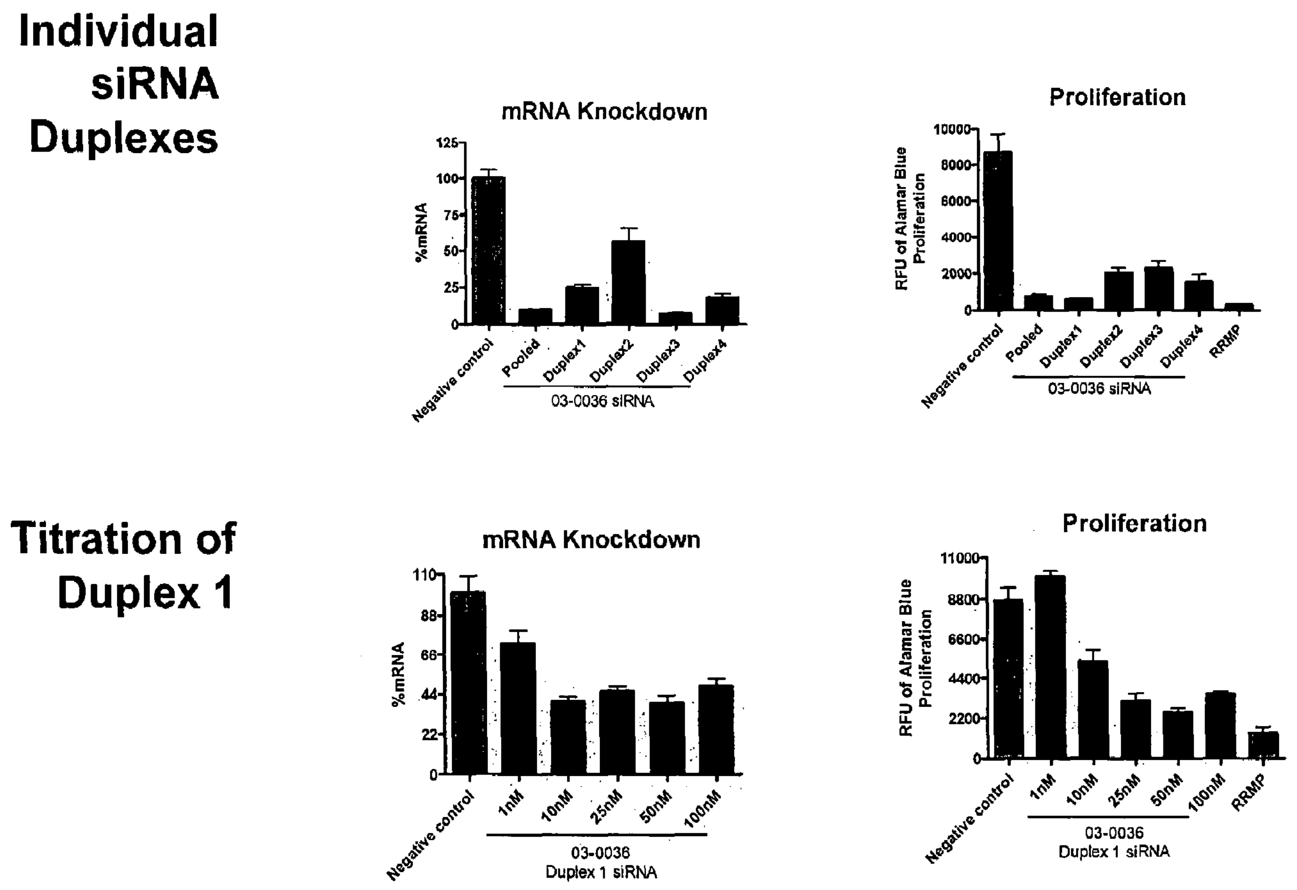

FIG. 176. Knockdown of CXADR mRNA Inhibits Proliferation in HCT116 Colon Cells.

Figure 177:
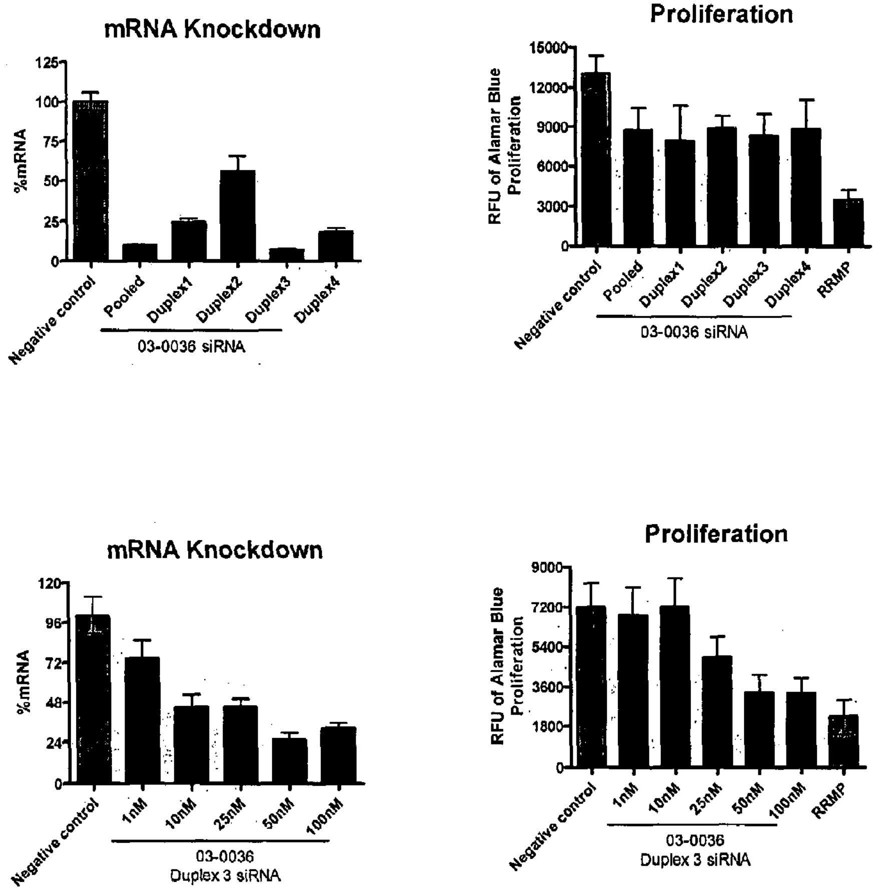

FIG. 177. Knockdown of CXADR mRNA Inhibits Proliferation in HT29 Colon Cells.

Figure 178:
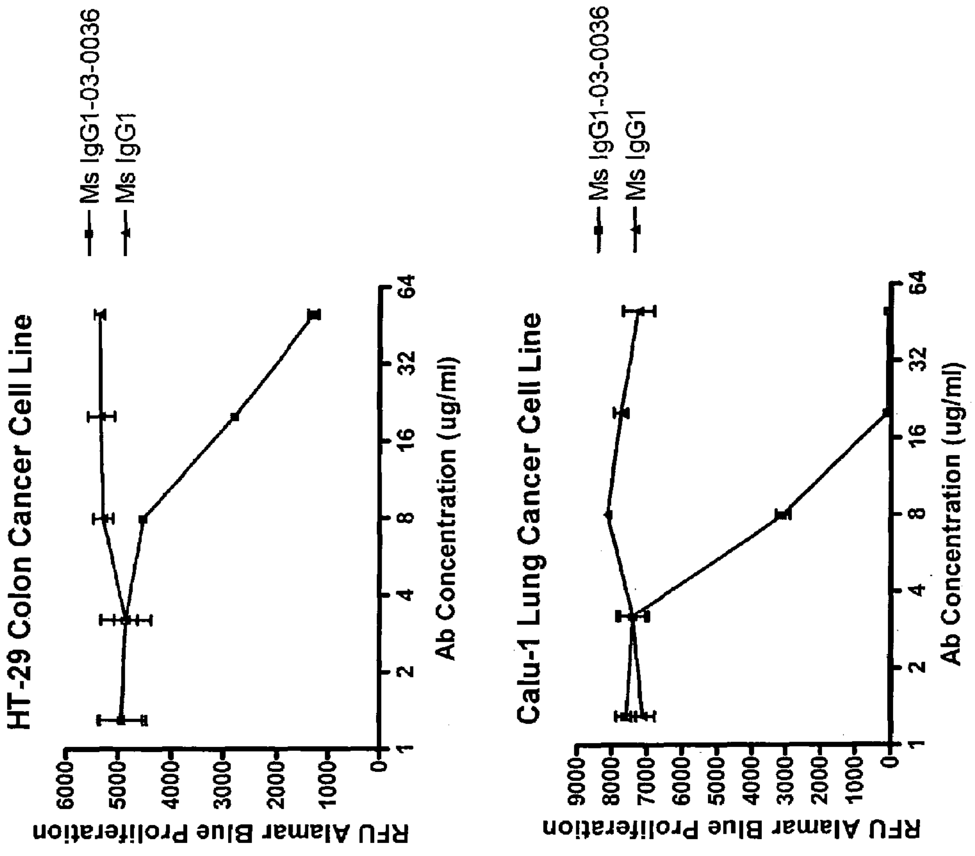

FIG. 178. Monoclonal Antibody to CXADR Inhibits Proliferation in Colon and Lung Cancer Cells.

Figure 179:
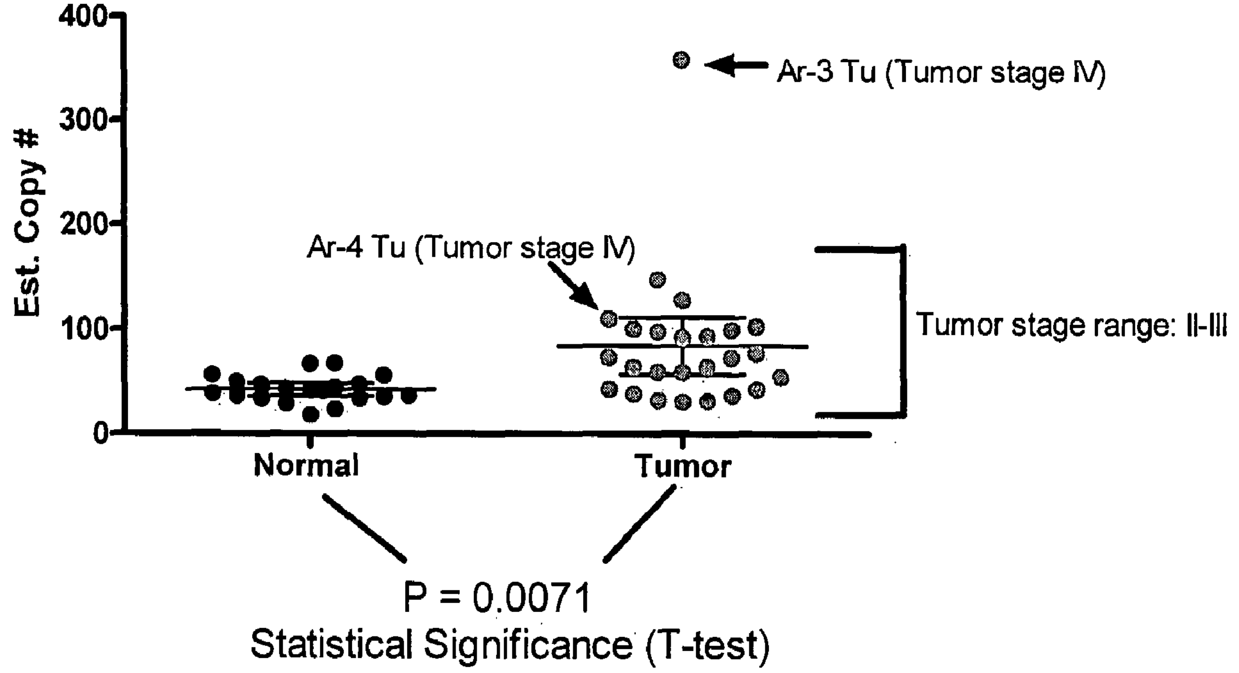

FIG. 179. CXADR mRNA is Overexpressed in Colon Tumor Tissues.

Figure 180:
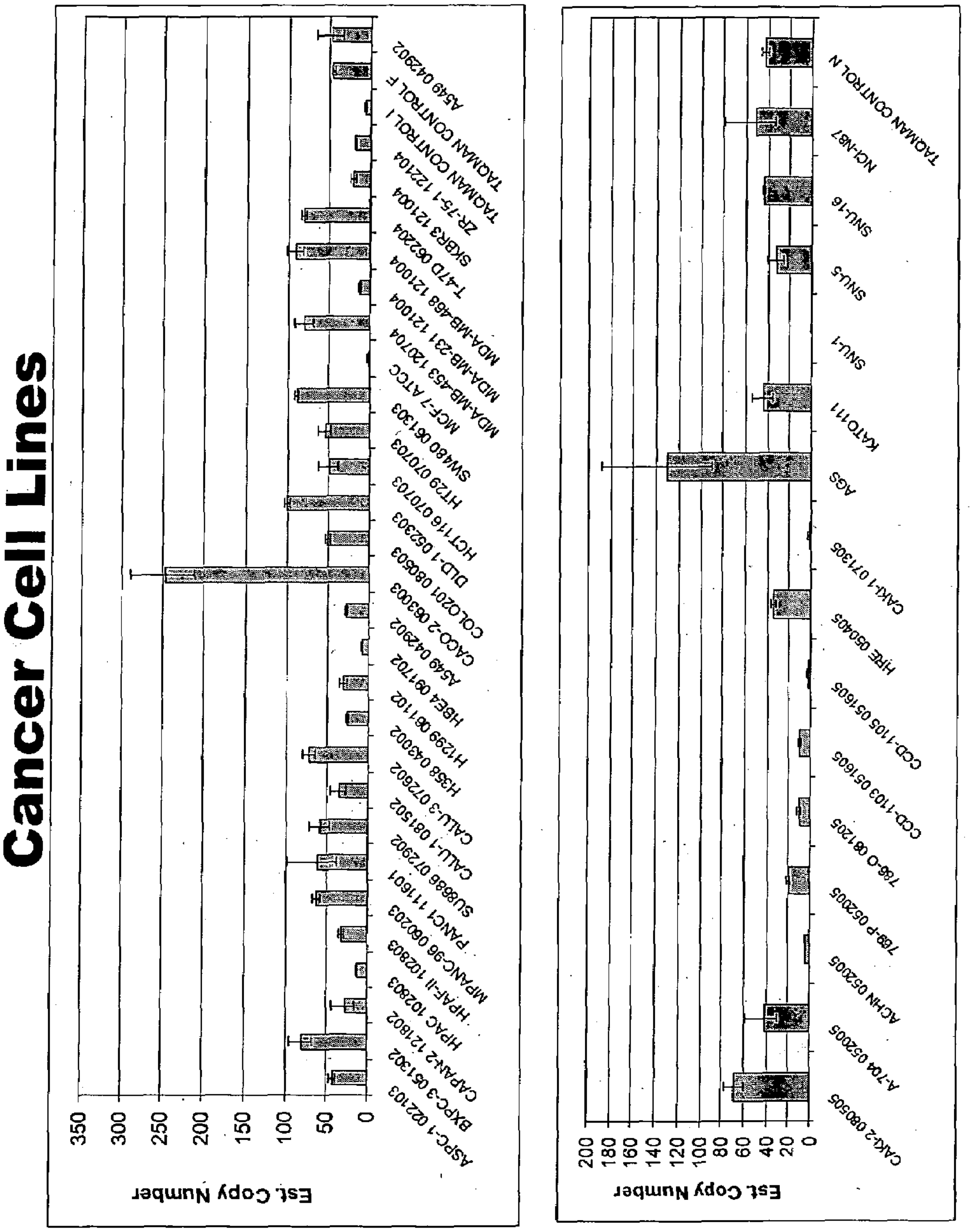

FIG. 180. CXADR is Highly Expressed at mRNA Level in Cancer Cell Lines.

Figure 181:
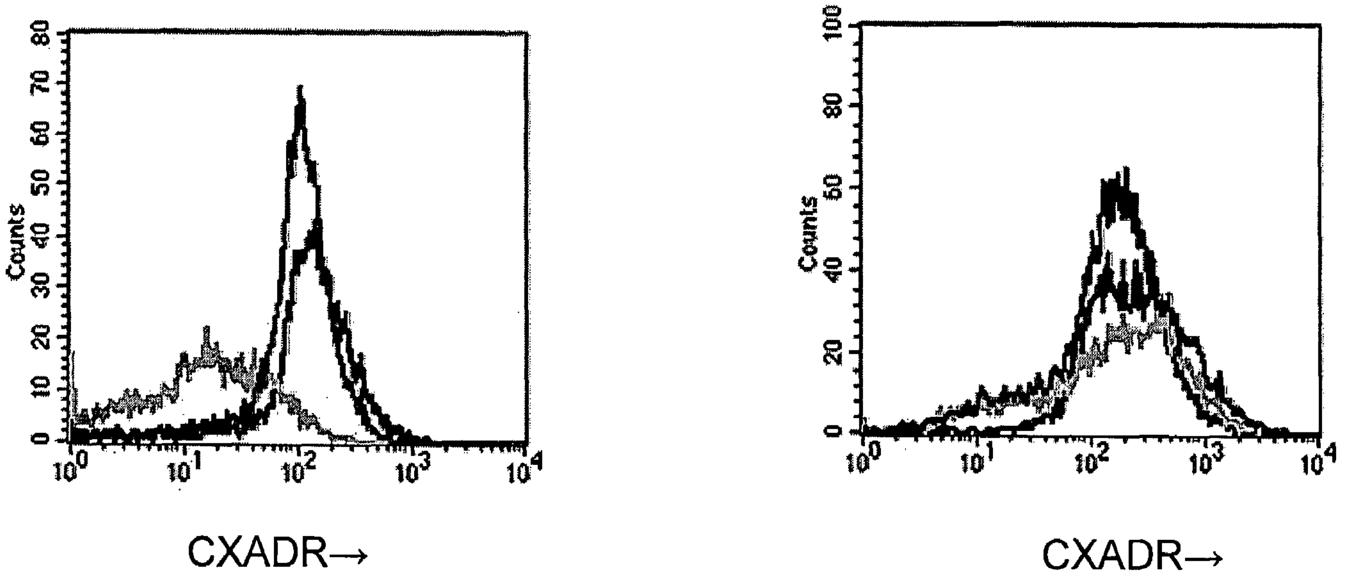

FIG. 181. CXADR Expression by FACS in 3D Spheroid Cells Derived from Colon and Lung Cancer Cell Lines.

FIG. 182. mRNA sequence of CXADR, indicating siRNA target regions.

PTK7

FIG. 183. PTK7 is Over-Expressed in Multiple Tumor Types.

Figure 184:
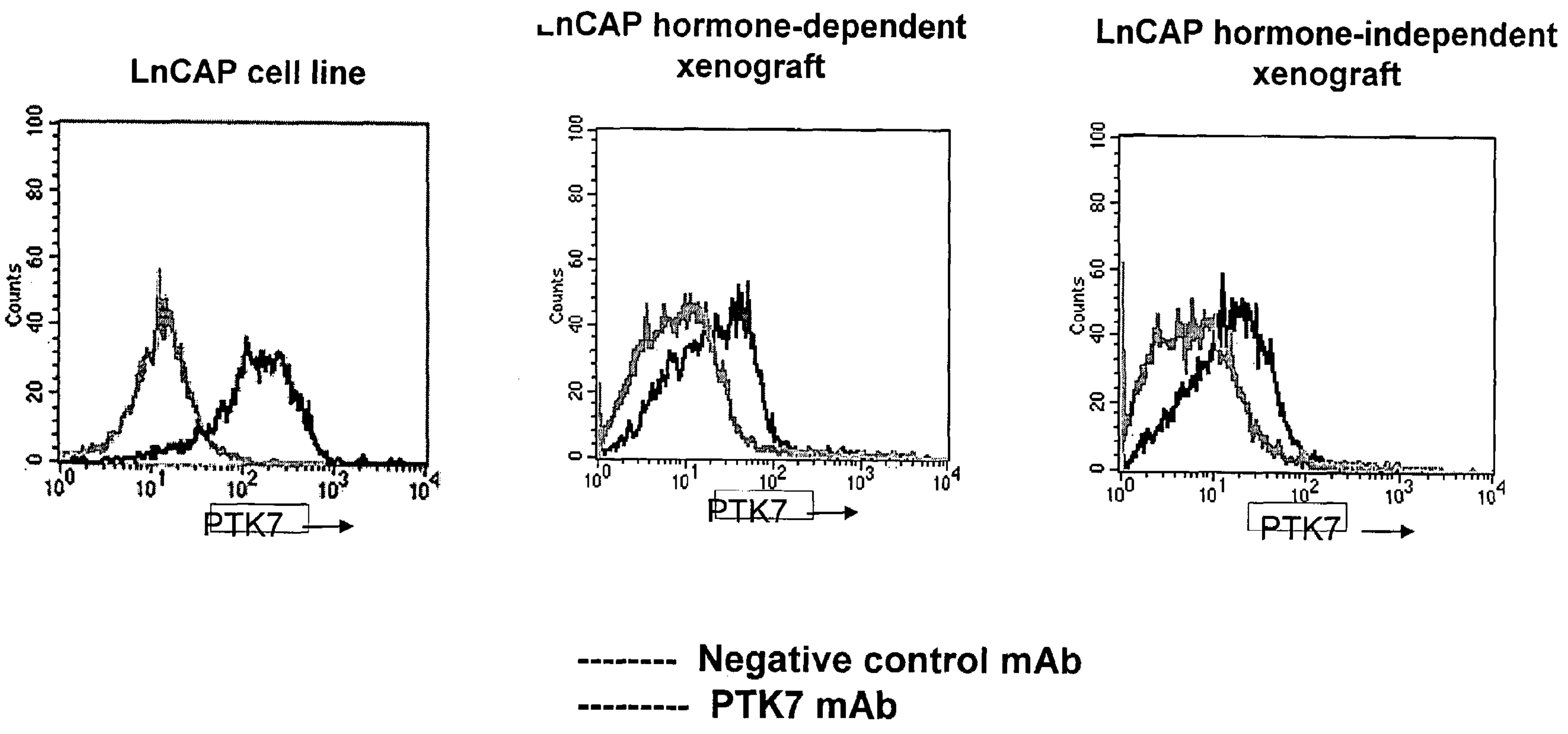

FIG. 184. PTK7 is Expressed in Hormone-Dependent and Hormone-Independent Prostate Xenografts.

Figure 185:
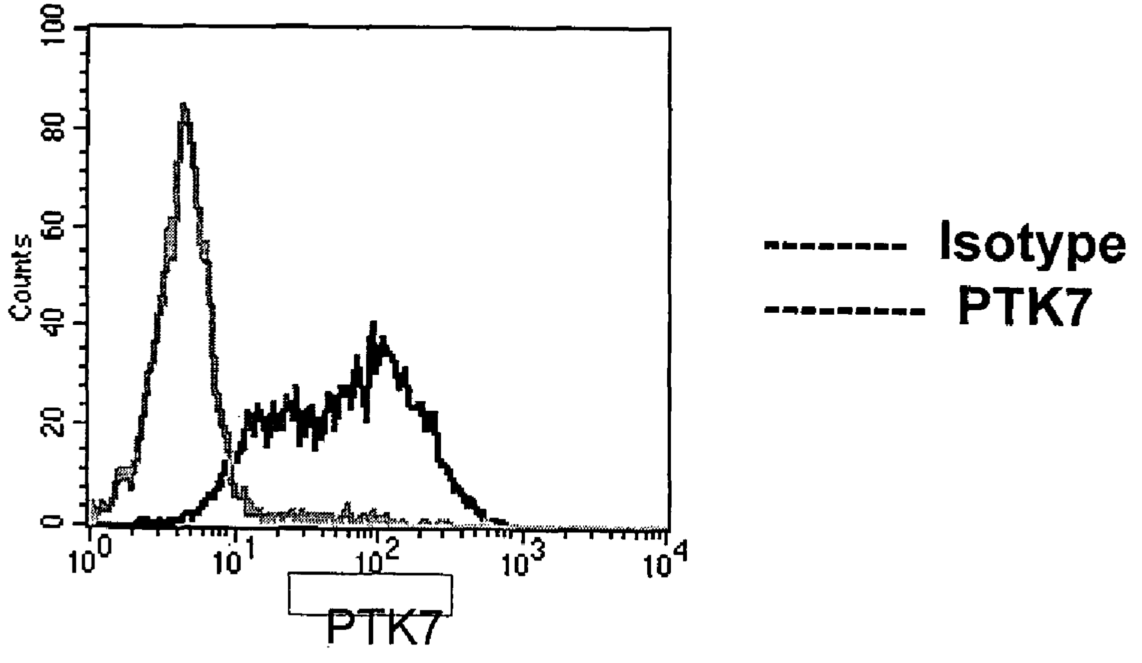

FIG. 185. PTK7 Is Expressed in H1299 Lung Cell Line.

FIG. 186. PTK7 Expression Observed on 3D Tumor Spheroid Cells.

Figure 187:
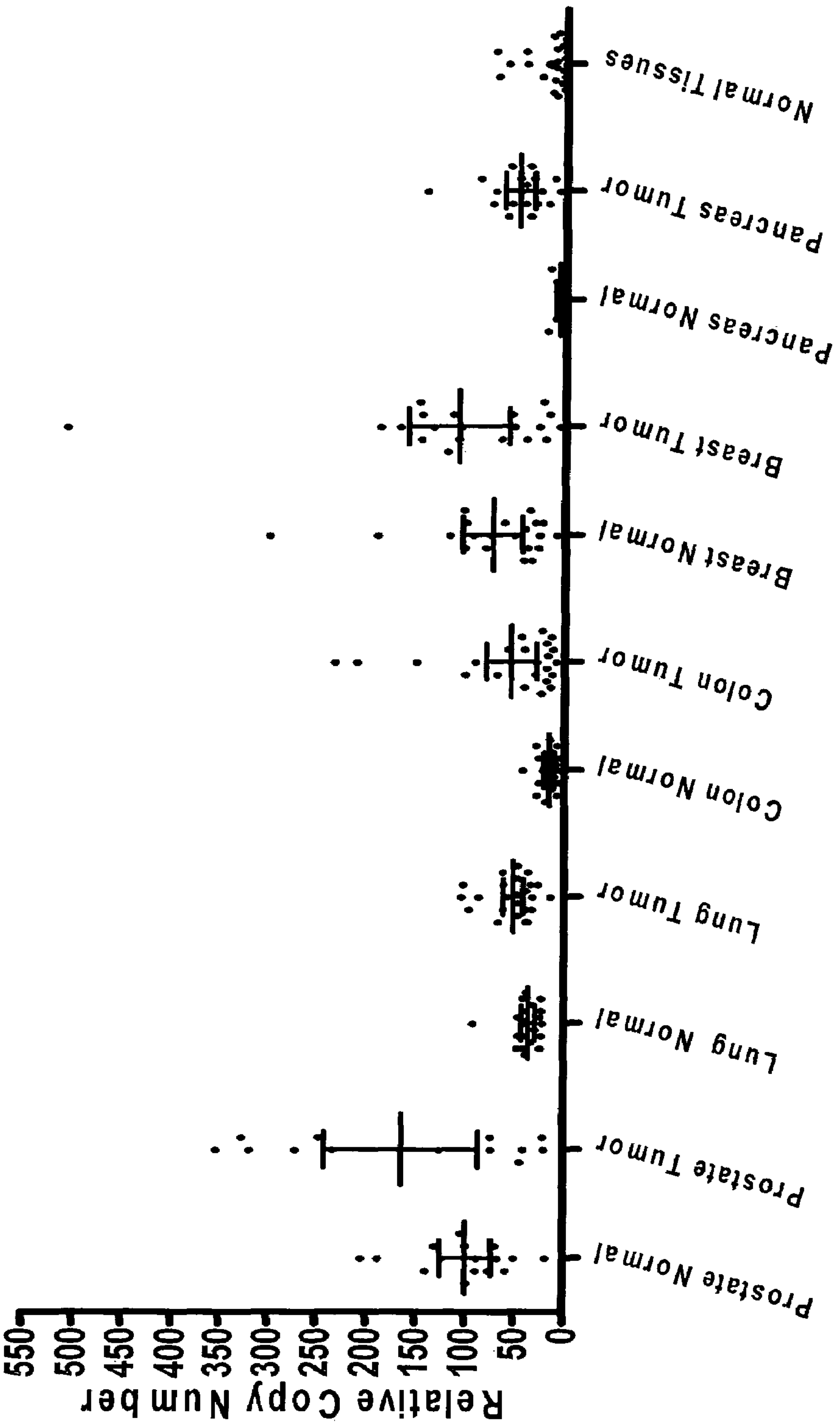

FIG. 187. PTK7 mRNA Expression Analysis in Multiple Tumor Tissues.

Figure 188:
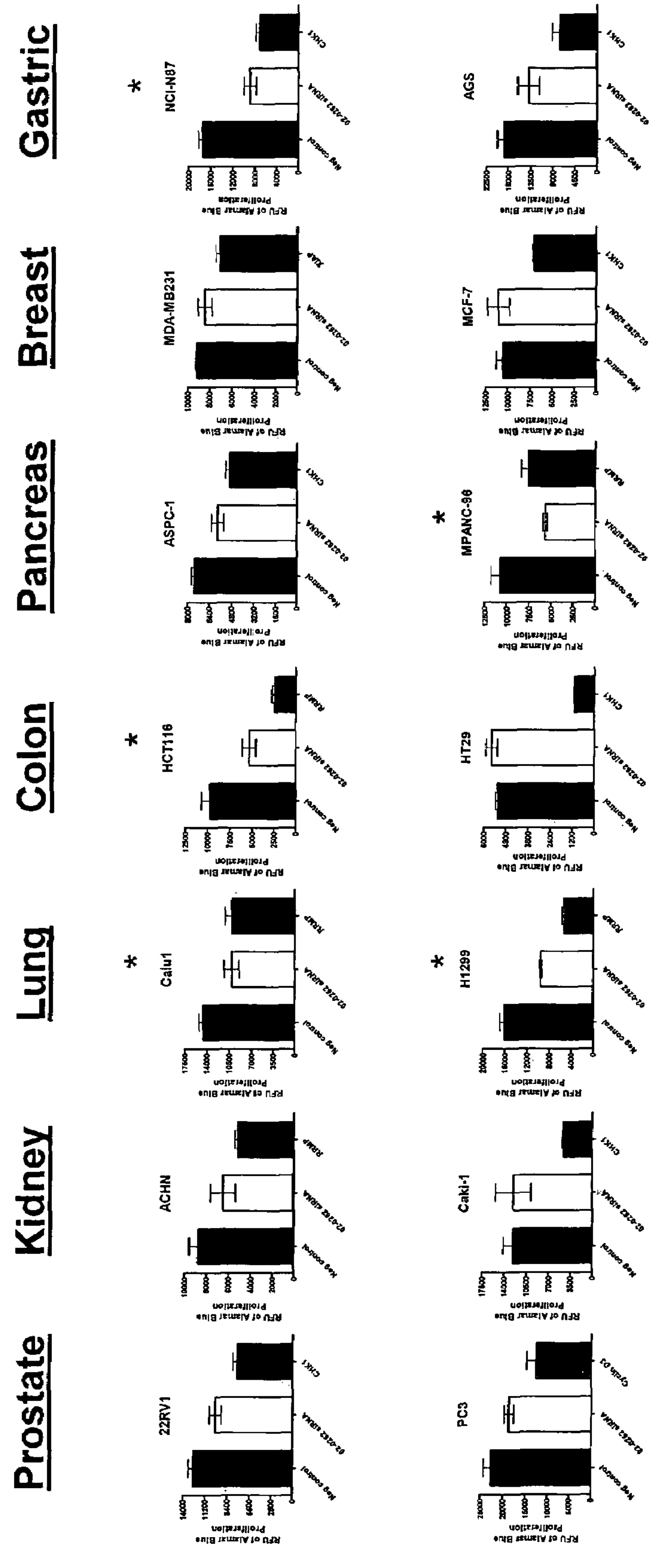

FIG. 188. Knockdown of PTK7 (02-0262) mRNA Inhibits Proliferation in Multiple Cell Lines.

Figure 189:
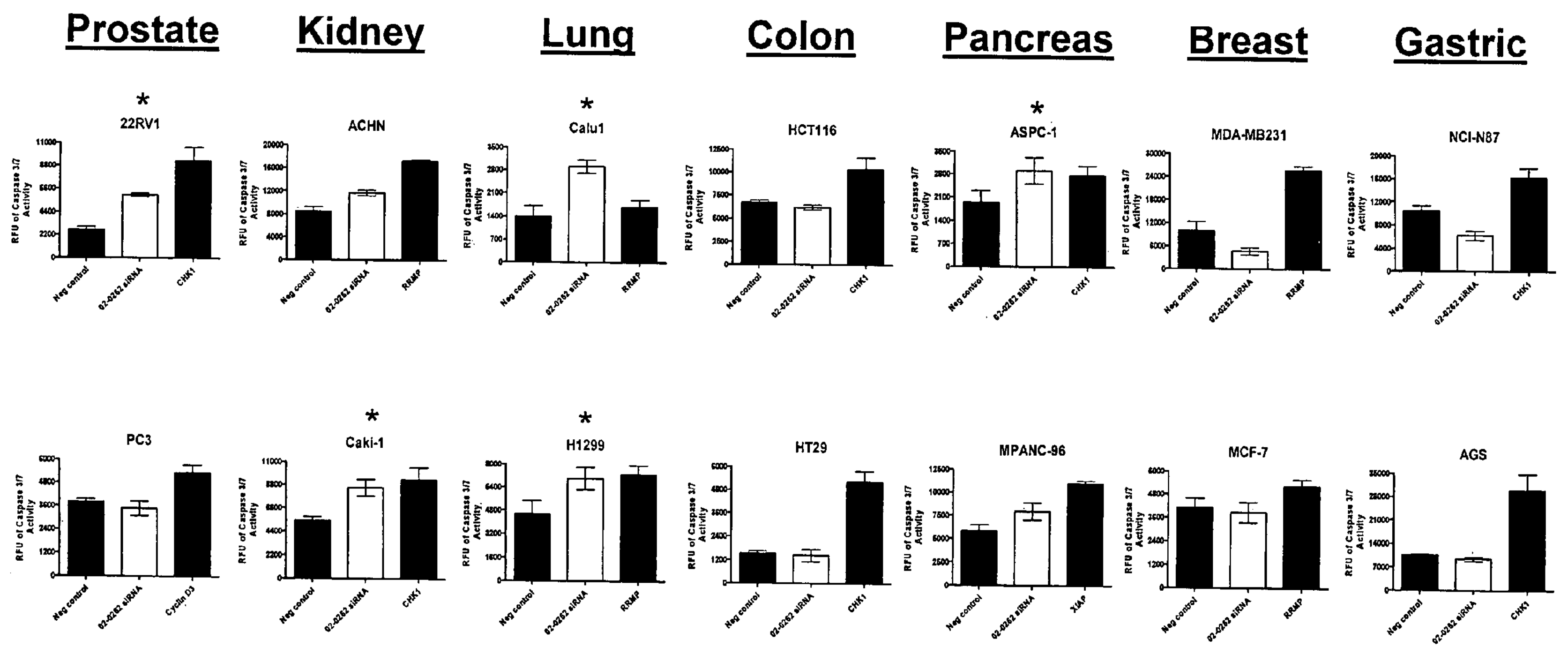

FIG. 189. Knockdown of PTK7 (02-0262) mRNA Induces Apoptosis in Multiple Cancer Cell Lines.

Figure 190:
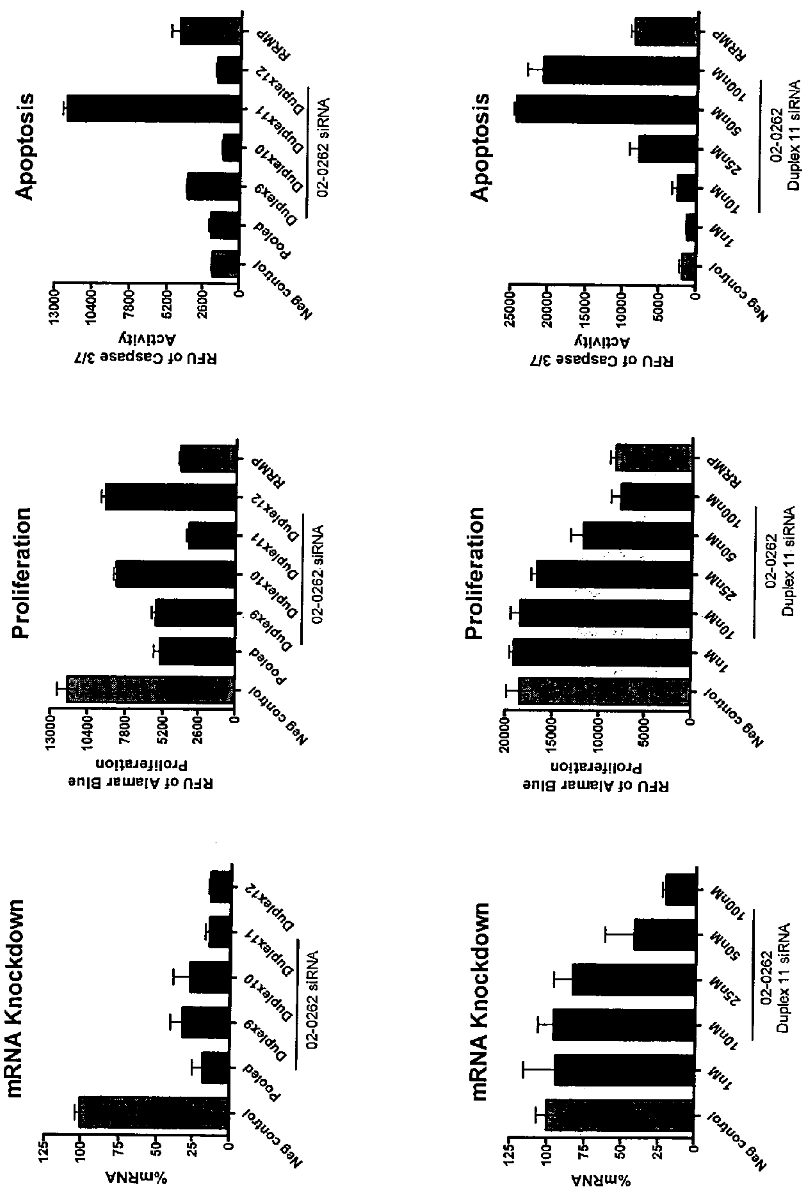

FIG. 190. Knockdown of PTK7 (02-0262) mRNA Inhibits Proliferation and Induces Apoptosis in H1299 Lung Cancer Cells.

Figure 191:
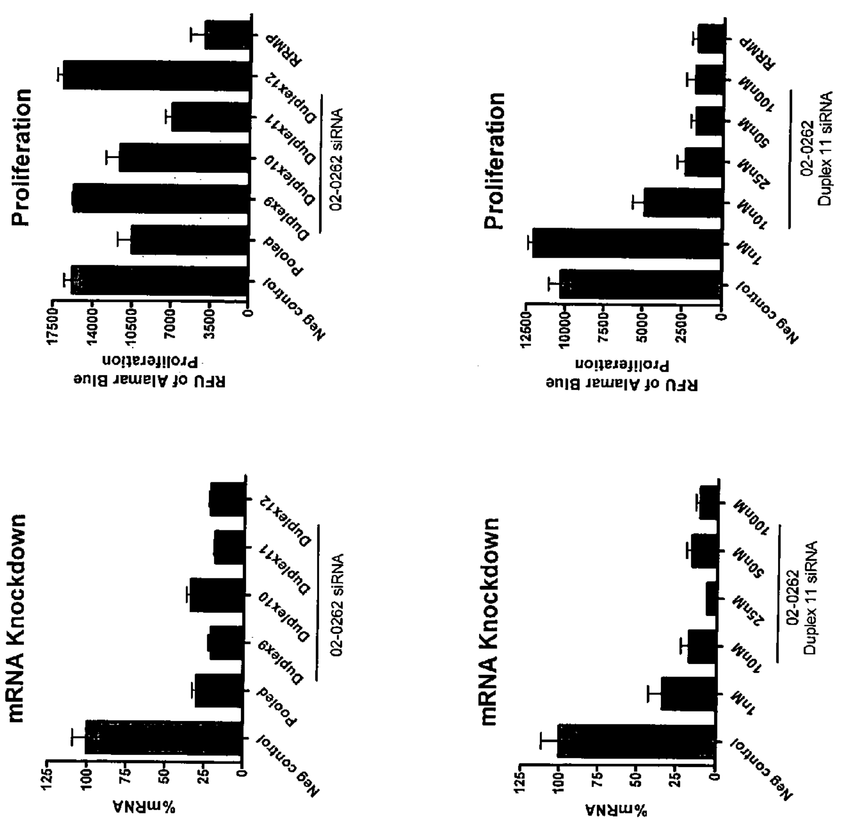

FIG. 191. Knockdown of PTK7 (02-0262) mRNA Inhibits Proliferation in HCT116 Colon Cancer Cells.

Figure 192:
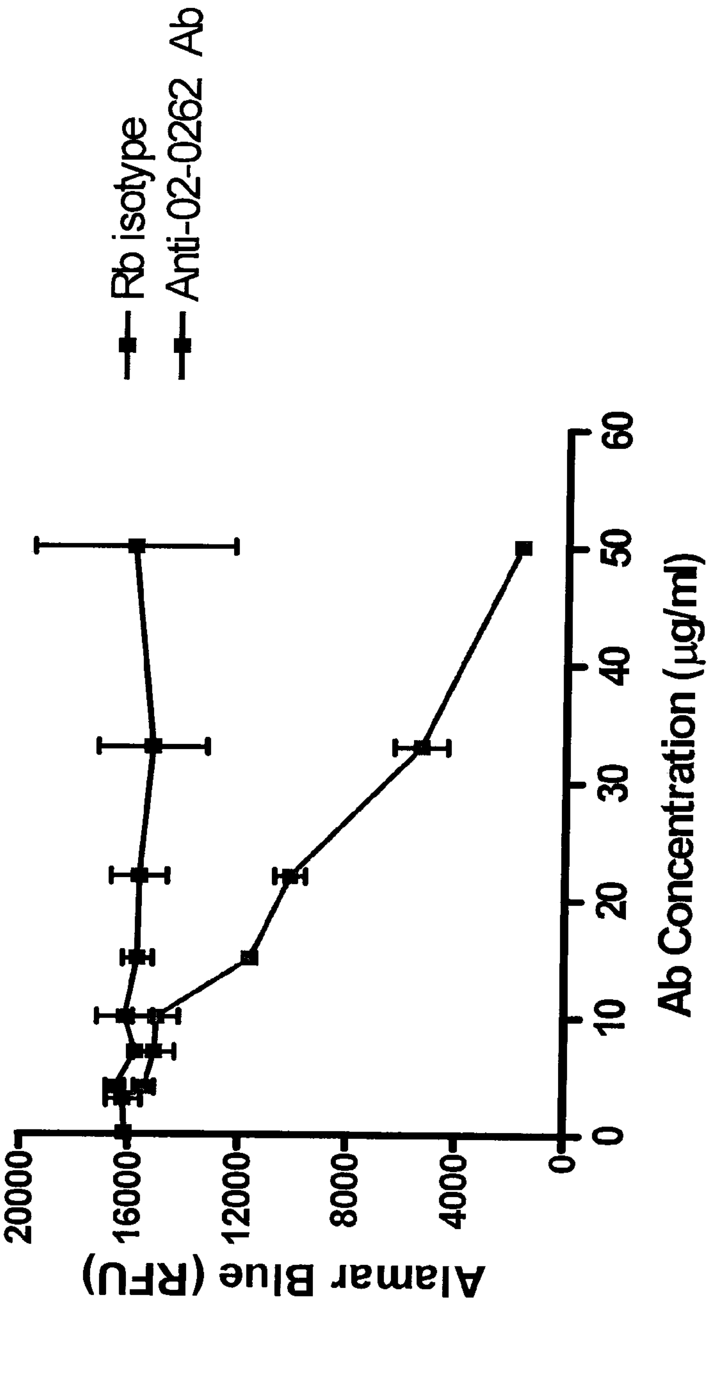

FIG. 192. Anti-PTK7 (02-0262) Ab Blocked H1299 Lung Tumor Cell Line Proliferation.

FIG. 193. PTK7 Copy Number Increase by CGH.

Figure 194:
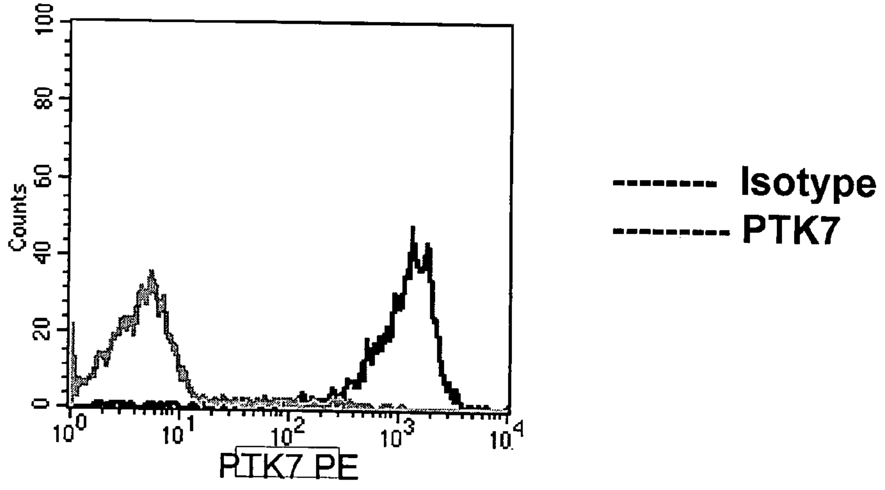

FIG. 194. PTK7 Expression on 3D Spheroid Cells Derived from ACHN Kidney Cancer Cell Line.

FIG. 195. PTK7 Expression in LnCAP Xenograft Isolated Cells.

Figure 196:
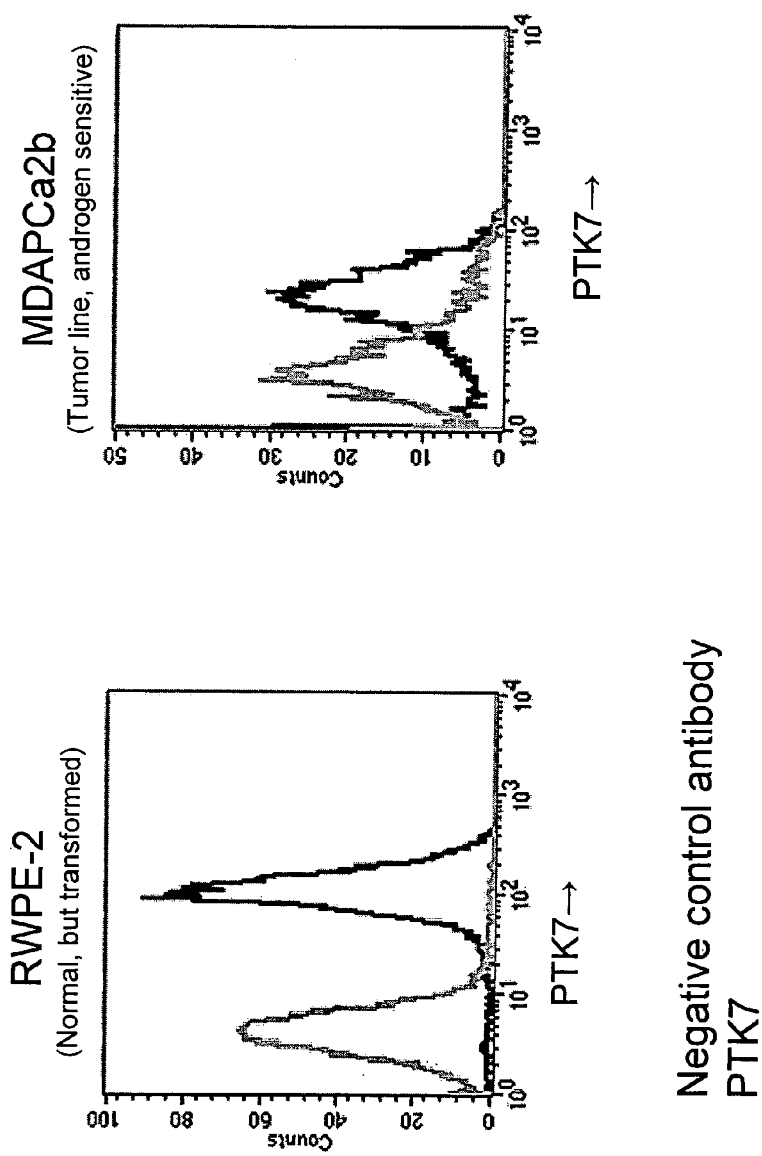

FIG. 196. PTK7 is Expressed on Prostate Cell Lines as Measured by Flow Cytometry.

Figure 197:
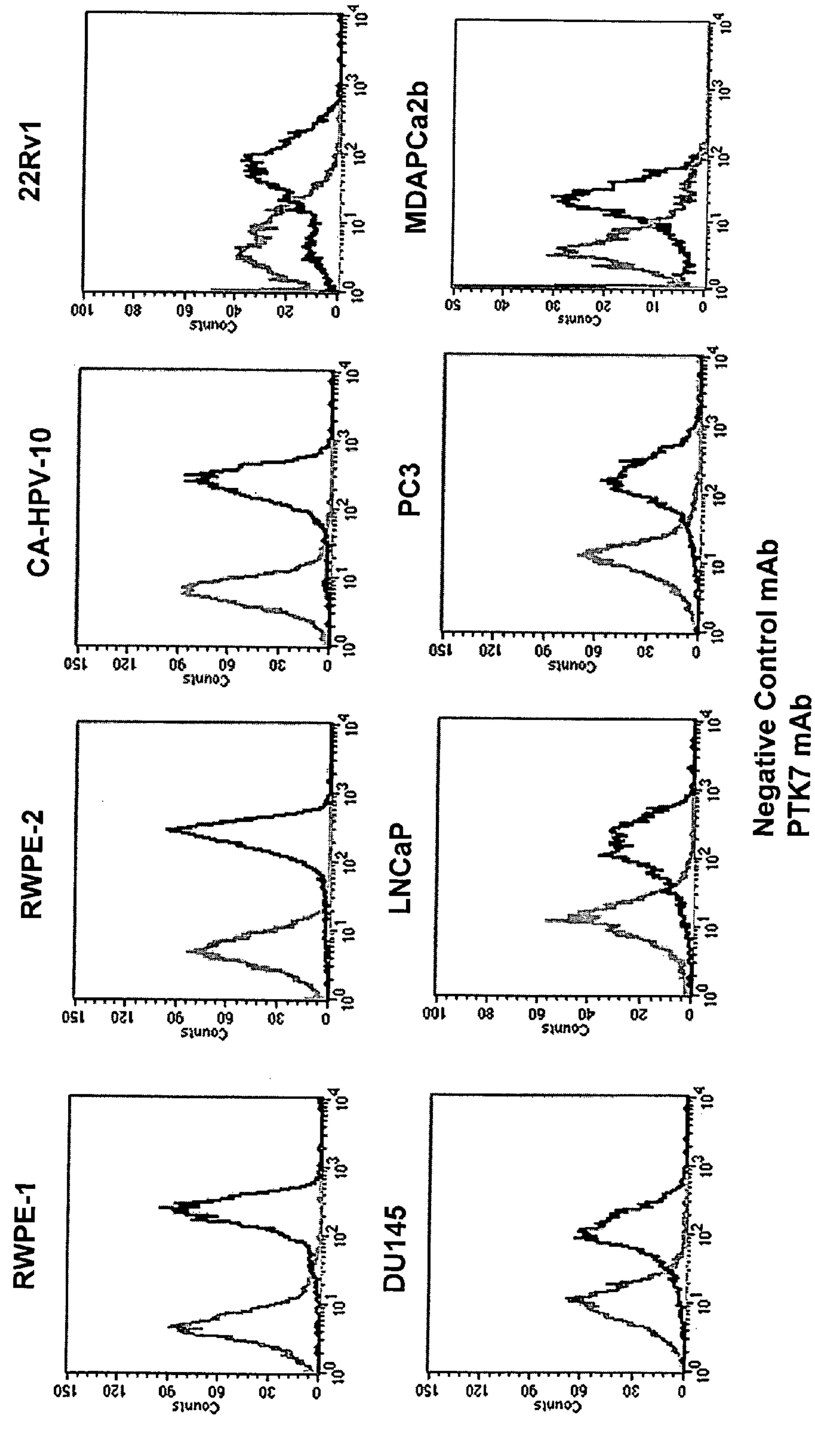

FIG. 197. PTK7 is Expressed by FACS on Prostate Cell Lines.

FIG. 198. PTK7 is Expressed on Prostate Cell Lines as Measured by Flow Cytometry.

FIG. 199. PTK7 is Expressed on Prostate Cell Lines as Measured by Flow Cytometry.

FIG. 200. PTK7 is Expressed on Prostate Cell Lines as Measured by Flow Cytometry.

FIG. 201. PTK7 is Expressed on Prostate Cell Lines as Measured by Flow Cytometry.

Figure 202:
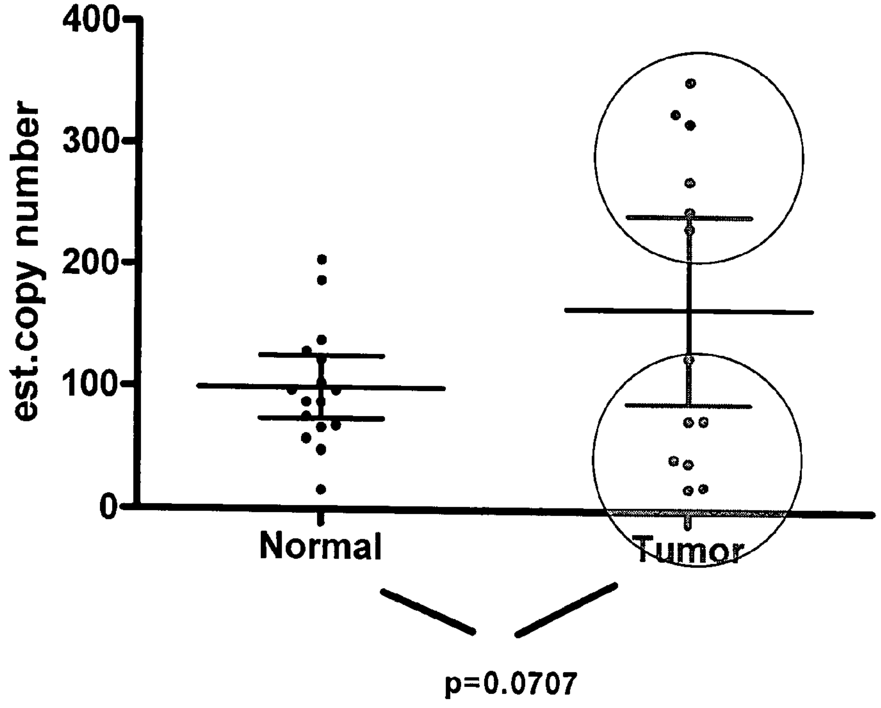

FIG. 202. PTK7 mRNA Expression in Prostate Tumors and Normal Tissues Demonstrates Two Populations in Prostate Tumors.

Figure 203:
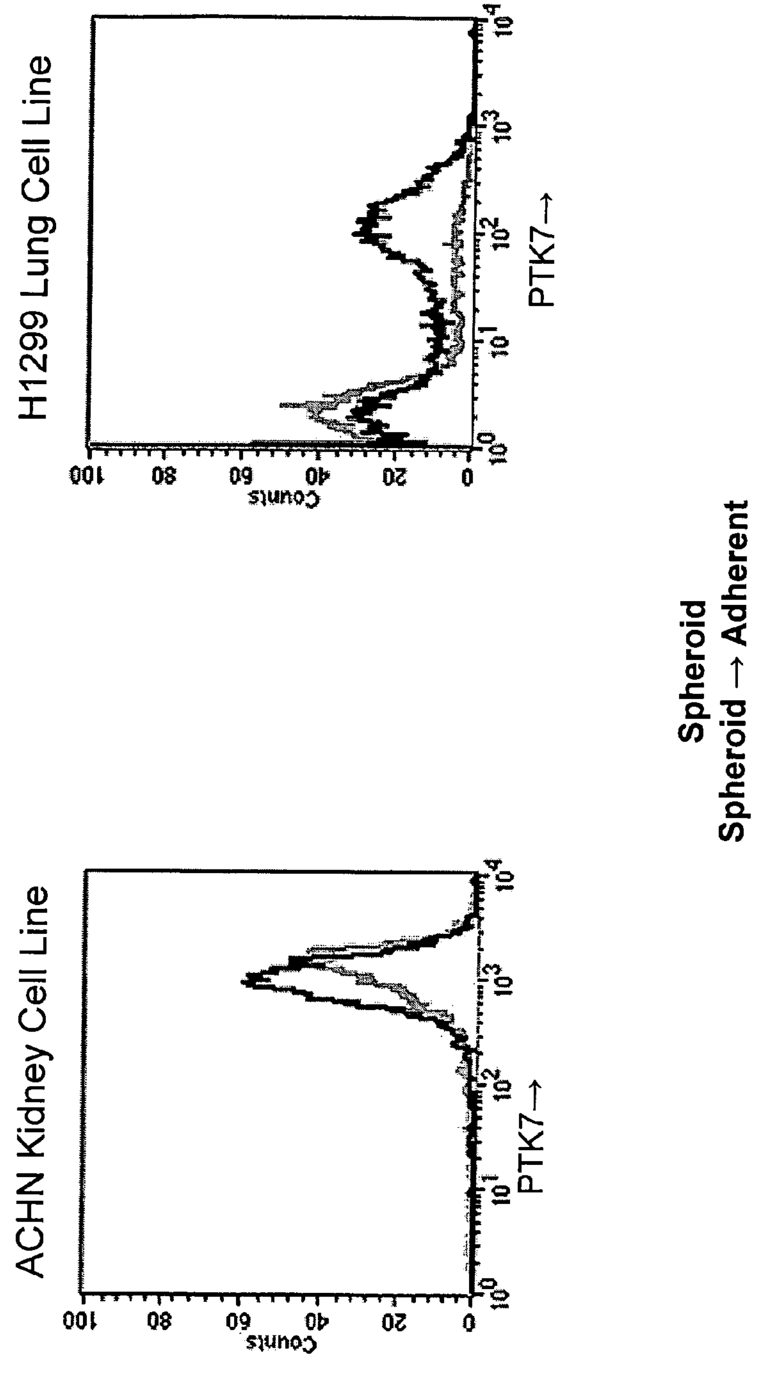

FIG. 203. PTK7 Expression in 3D Tumor Spheroid Cells Derived from Kidney and Lung Cancer Cell Lines.

Figure 204:
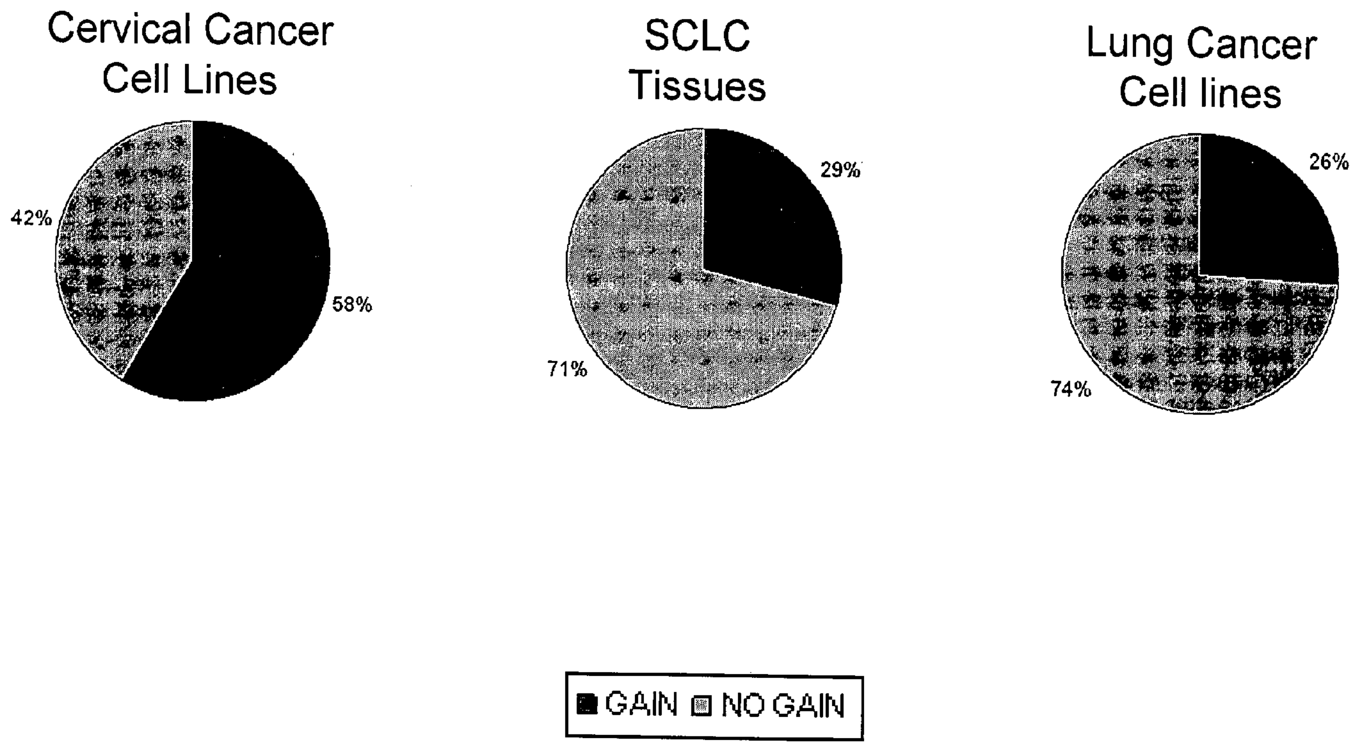

FIG. 204. Copy Number Increase by CGH.

FIG. 205. mRNA sequence of PTK7, indicating siRNA target regions.

MISTR

FIG. 206. MISTR is Over-Expressed in Multiple Tumor Types.

Figure 207:
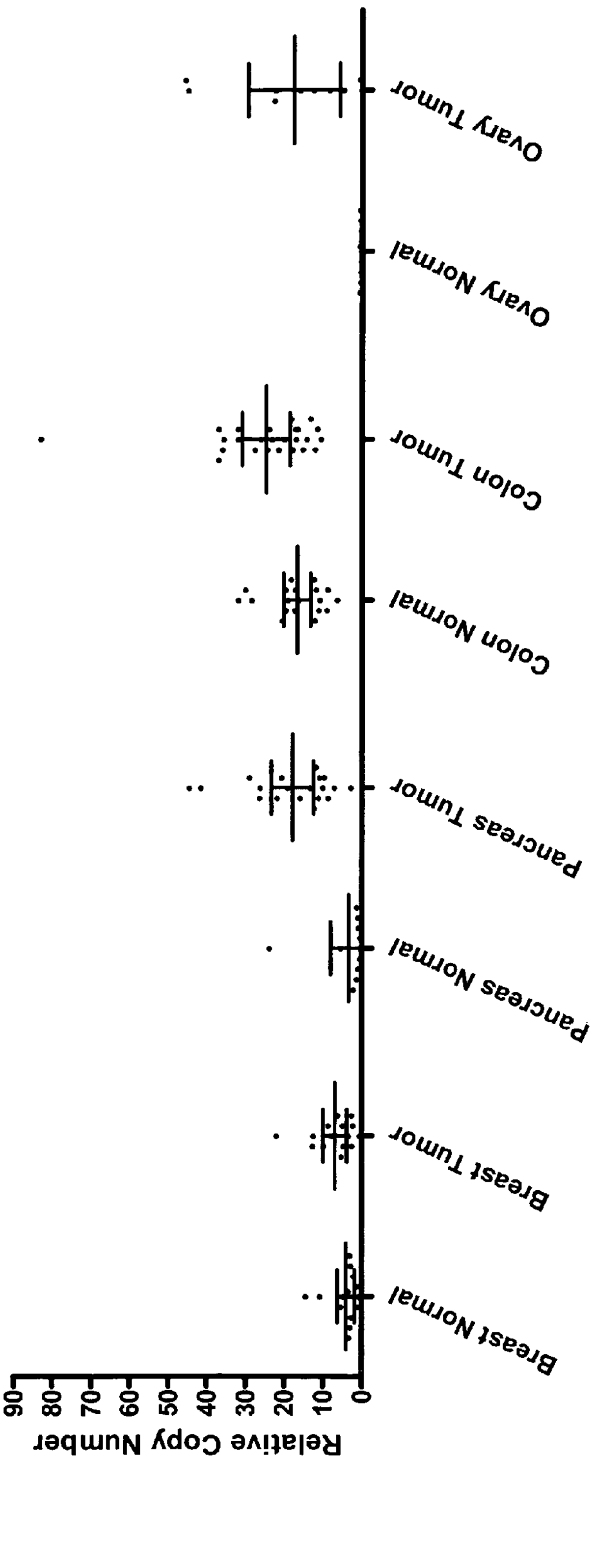

FIG. 207. MISTR mRNA Expression Analysis in Multiple Tumor Tissues.

Figure 208:
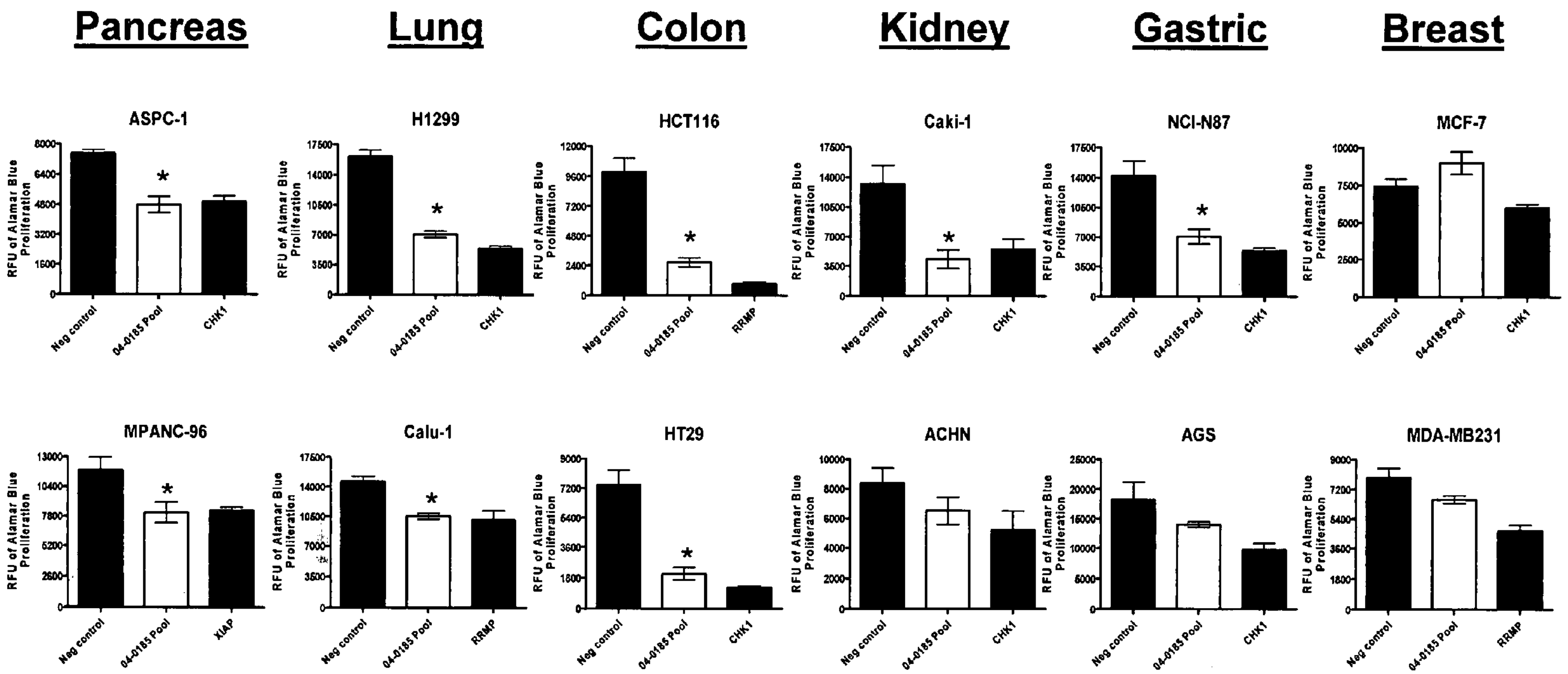

FIG. 208. Knockdown of MISTR mRNA Inhibits Proliferation in Pancreas, Lung, Colon, Kidney and Gastric Cancer Cells.

Figure 209:
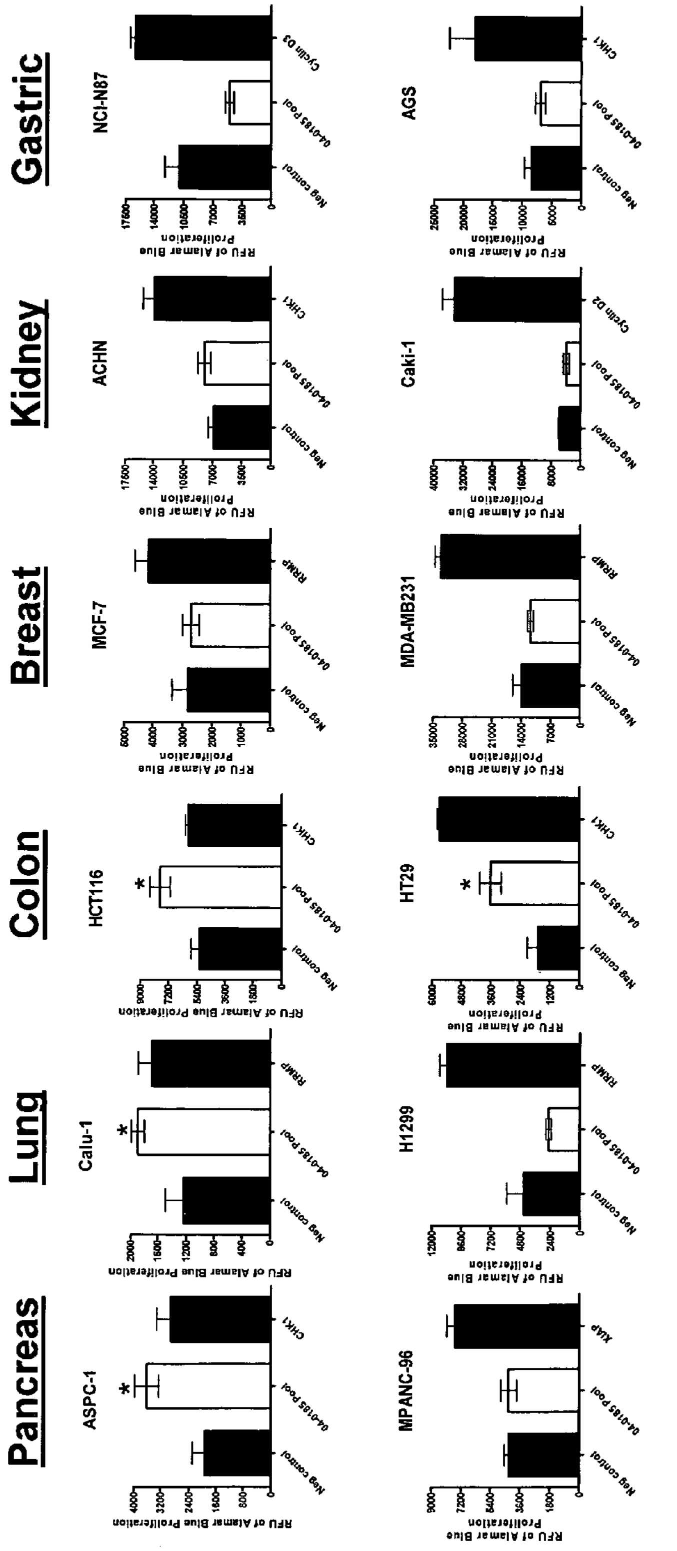

FIG. 209. Knockdown of MISTR mRNA Induces Apoptosis in Pancreas, Lung and Colon Cancer Cells.

Figure 210:
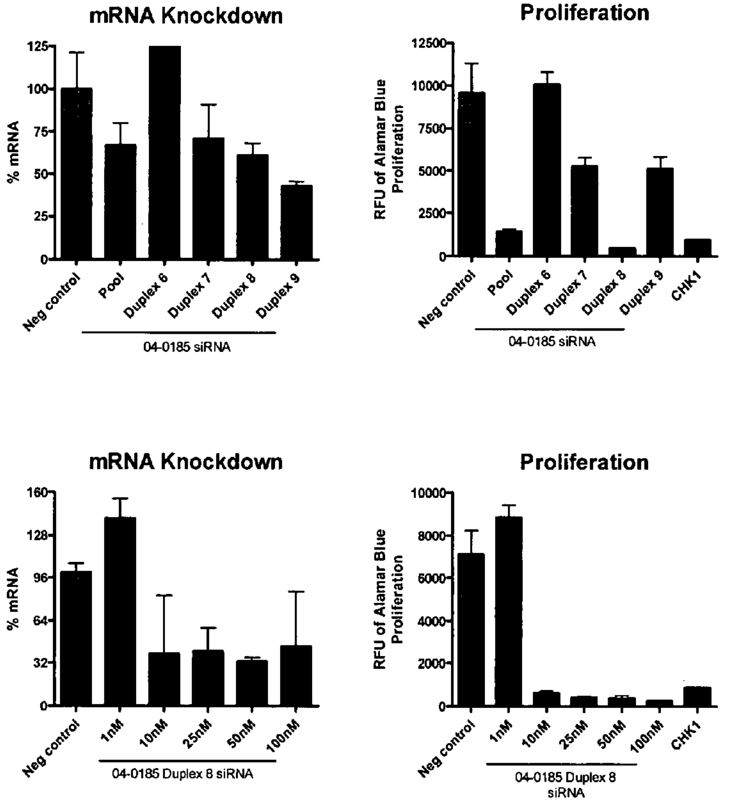

FIG. 210. Knockdown of MISTR mRNA Inhibits Proliferation in HCT116 Colon Cancer Cells.

Figure 211:
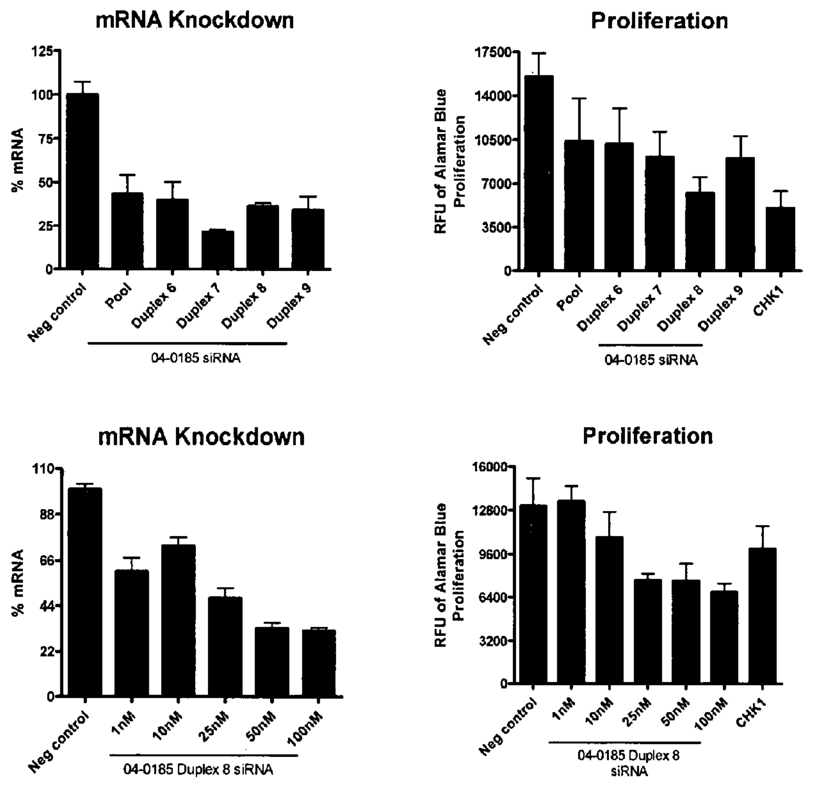

FIG. 211. Knockdown of MISTR mRNA Inhibits Proliferation in MPANC96 Pancreatic Cancer Cells.

Figure 212:
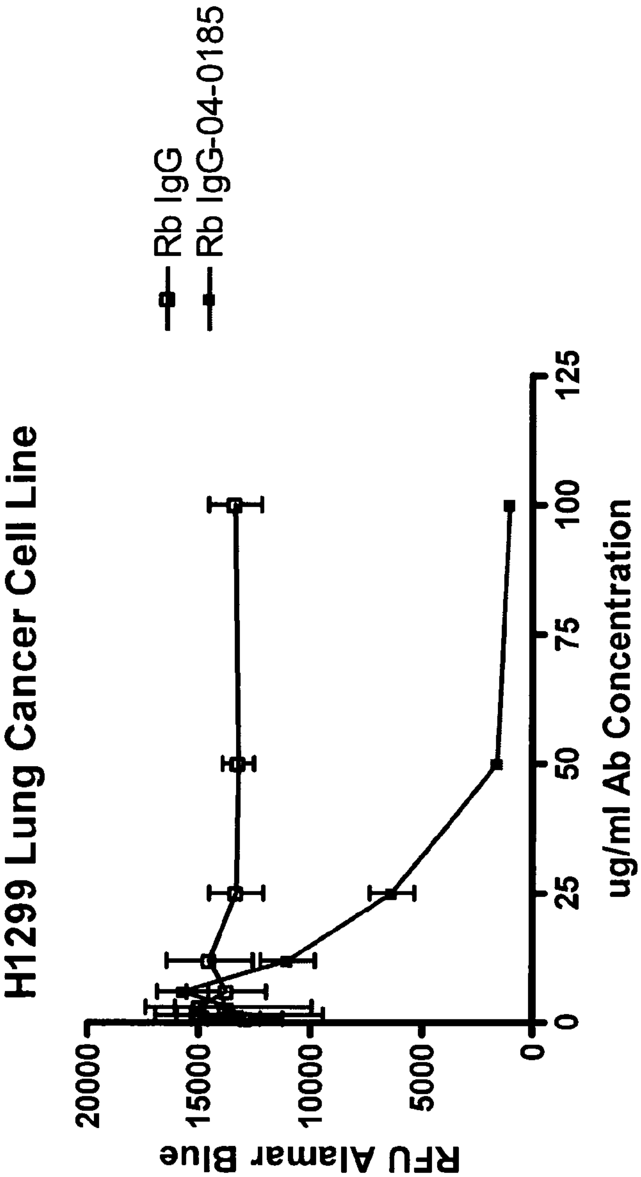

FIG. 212. Anti-MISTR Polyclonal Antibody Inhibits Proliferation in Lung Cancer Cells.

FIG. 213. mRNA sequence of MISTR, indicating siRNA target regions.

DETAILED DESCRIPTION OF THE PREFERRED EMBODIMENTS

1. CAT Proteins and Peptides

The present invention provides the following targets and methods of using these targets: GFRa1, Claudin-4, ASCT2, CD166-ALCAM, CD55, TG2, CD49f, CD98, CD104, DPEP1, Tissue Factor (TF), Na-K ATPase beta3, VIPR1, CD26, CXADR, PTK7, and MISTR (see Figures), which are collectively referred to herein as “CAT” (cancer-associated targets). In particular, the present invention provides methods of using these targets for diagnosing and treating cancer. Each of these targets is associated with specific types of cancers in particular, as shown in the Figures and described in section 14 of the Examples section (“Summary of experimental validation”).

The present invention provides isolated CAT peptides and proteins consisting of, consisting essentially of, or comprising the amino acid sequences of SEQ ID NOS:1-4,9,11-12, 16-19, 24-36, 51-59, 69-74, 81-85, 91-102, 115-116, 119-121, 127-134, 144-145, 148-149, 152-159, 168-174, and 182-183, respectively encoded by the nucleic acid molecules having the nucleotide sequences of SEQ ID NOS:5-8, 10, 13-15, 20-23, 37-50, 60-68, 75-80, 86-90, 103-114, 117-118, 122-126, 135-143, 146-147, 150-151, 160-167, 175-181, 184-185, as well as all obvious variants of these peptides that are within the art to make and use. Some of these variants are described in detail below.

A CAT peptide or protein can be attached to heterologous sequences to form chimeric or fusion proteins. Such chimeric and fusion proteins comprise a peptide operatively linked to a heterologous protein having an amino acid sequence not substantially homologous to the peptide. “Operatively linked” indicates that the peptide and the heterologous protein are fused in-frame. The heterologous protein can be fused to the N-terminus or C-terminus of the peptide.

In some uses, the fusion protein does not affect the activity of the peptide or protein per se. For example, the fusion protein can include, but is not limited to, fusion proteins, for example beta-galactosidase fusions, yeast two-hybrid GAL fusions, poly-His fusions, MYC-tagged, HI-tagged and Ig fusions. Such fusion proteins, particularly poly-His fusions, can facilitate the purification of recombinant CAT proteins or peptides. In certain host cells (e.g., mammalian host cells), expression and/or secretion of a protein can be increased by using a heterologous signal sequence.

A chimeric or fusion CAT protein or peptide can be produced by standard recombinant DNA techniques. For example, DNA fragments coding for the different protein sequences are ligated together in-frame in accordance with conventional techniques. In another embodiment, the fusion gene can be synthesized by conventional techniques including automated DNA synthesizers. Alternatively, PCR amplification of gene fragments can be carried out using anchor primers which give rise to complementary overhangs between two consecutive gene fragments which can subsequently be annealed and re-amplified to generate a chimeric gene sequence (see Ausubel et al., Current Protocols in Molecular Biology, 1992). Moreover, many expression vectors are commercially available that already encode a fusion moiety (e.g., a GST protein). A CAT-encoding nucleic acid can be cloned into such an expression vector such that the fusion moiety is linked in-frame to the CAT protein or peptide.

Variants of a CAT protein can readily be identified/made using molecular techniques and the sequence information disclosed herein. Further, such variants can readily be distinguished from other peptides based on sequence and/or structural homology to the CAT peptides of the present invention. The degree of homology/identity present will be based primarily on whether the peptide is a functional variant or non-functional variant, the amount of divergence present in the paralog family and the evolutionary distance between the orthologs.

To determine the percent identity of two amino acid sequences or two nucleic acid sequences, the sequences are aligned for optimal comparison purposes (e.g., gaps can be introduced in one or both of a first and a second amino acid or nucleic acid sequence for optimal alignment and non-homologous sequences can be disregarded for comparison purposes). In a preferred embodiment, at least 30%, 40%, 50%, 60%, 70%, 80%, or 90% or more of the length of a reference sequence is aligned for comparison purposes. The amino acid residues or nucleotides at corresponding amino acid positions or nucleotide positions are then compared. When a position in the first sequence is occupied by the same amino acid residue or nucleotide as the corresponding position in the second sequence, then the molecules are identical at that position (as used herein amino acid or nucleic acid “identity” is equivalent to amino acid or nucleic acid “homology”). The percent identity between the two sequences is a function of the number of identical positions shared by the sequences, taking into account the number of gaps, and the length of each gap, which need to be introduced for optimal alignment of the two sequences.

The comparison of sequences and determination of percent identity and similarity between two sequences can be accomplished using a mathematical algorithm. (Computational Molecular Biology, Lesk, A. M., ed., Oxford University Press, New York, 1988; Biocomputing: Informatics and Genome Projects, Smith, D. W., ed., Academic Press, New York, 1993; Computer Analysis of Sequence Data, Part 1, Griffin, A. M., and Griffin, H. G., eds., Humana Press, New Jersey, 1994; Sequence Analysis in Molecular Biology, von Heinje, G., Academic Press, 1987; and Sequence Analysis Primer, Gribskov, M. and Devereux, J., eds., M Stockton Press, New York, 1991). In a preferred embodiment, the percent identity between two amino acid sequences is determined using the Needleman and Wunsch (J. Mol. Biol. (48): 444-453 (1970)) algorithm which has been incorporated into the GAP program in the GCG software package, using either a Blossom 62 matrix or a PAM250 matrix, and a gap weight of 16, 14, 12, 10, 8, 6, or 4 and a length weight of 1, 2, 3, 4, 5, or 6. In yet another preferred embodiment, the percent identity between two nucleotide sequences is determined using the GAP program in the GCG software package (Devereux, J., et al., Nucleic Acids Res. 12(1):387 (1984)), using a NWS-gapdna.CMP matrix and a gap weight of 40, 50, 60, 70, or 80 and a length weight of 1, 2, 3, 4, 5, or 6. In another embodiment, the percent identity between two amino acid or nucleotide sequences is determined using the algorithm of E. Myers and W. Miller (CABIOS, 4:11-17 (1989)) which has been incorporated into the ALIGN program (version 2.0), using a PAM120 weight residue table, a gap length penalty of 12 and a gap penalty of 4.

The nucleic acids and protein sequences of the present invention can further be used as a "query sequence" to perform a search against sequence databases to, for example, identify other family members or related sequences. Such searches can be performed using the NBLAST and XBLAST programs (version 2.0) of Altschul, et al. (J. Mol. Biol. 215: 403-10 (1990)). BLAST nucleotide searches can be performed with the NBLAST program, score=100, wordlength=12 to obtain nucleotide sequences homologous to the nucleic acid molecules of the invention. BLAST protein searches can be performed with the XBLAST program, score=50, wordlength=3 to obtain amino acid sequences homologous to the proteins of the invention. To obtain gapped alignments for comparison purposes, Gapped BLAST can be utilized as described in Altschul et al. (Nucleic Acids Res. 25(17):3389-3402 (1997)). When utilizing BLAST and gapped BLAST programs, the default parameters of the respective programs (e.g., XBLAST and NBLAST) can be used.

Allelic variants of a CAT peptide can readily be identified as being a human protein having a high degree (significant) of sequence homology/identity to at least a portion of the CAT peptide as well as being encoded by the same genetic locus as the CAT peptide provided herein. Genetic locus can readily be determined based on the genomic information. As used herein, two proteins (or a region of the proteins) have significant homology when the amino acid sequences are typically at least about 70-80%, 80-90%, and more typically at least about 90-95% or more homologous. A significantly homologous amino acid sequence, according to the present invention, will be encoded by a nucleic acid sequence that will hybridize to a CAT peptide encoding nucleic acid molecule under stringent conditions as more fully described below.

Paralogs of a CAT peptide can readily be identified as having some degree of significant sequence homology/identity to at least a portion of the CAT peptide, as being encoded by a gene from humans, and as having similar activity or function. Two proteins will typically be considered paralogs when the amino acid sequences are typically at least about 60% or greater, and more typically at least about 70% or greater homology through a given region or domain. Such paralogs will be encoded by a nucleic acid sequence that will hybridize to a CAT peptide encoding nucleic acid molecule under moderate to stringent conditions as more fully described below.

Orthologs of a CAT peptide can readily be identified as having some degree of significant sequence homology/identity to at least a portion of the CAT peptide as well as being encoded by a gene from another organism. Preferred orthologs will be isolated from mammals, preferably primates, for the development of human therapeutic targets and agents. Such orthologs will be encoded by a nucleic acid sequence that will hybridize to a CAT peptide-encoding nucleic acid molecule under moderate to stringent conditions, as more fully described below, depending on the degree of relatedness of the two organisms yielding the proteins.

Non-naturally occurring variants of the CAT peptides of the present invention can readily be generated using recombinant techniques. Such variants include, but are not limited to deletions, additions and substitutions in the amino acid sequence of the CAT peptide. For example, one class of substitutions is conserved amino acid substitution. Such substitutions are those that substitute a given amino acid in a CAT peptide by another amino acid of like characteristics. Typically seen as conservative substitutions are the replacements, one for another, among the aliphatic amino acids Ala, Val, Leu, and Ile; interchange of the hydroxyl residues Ser and Thr; exchange of the acidic residues Asp and Glu; substitution between the amide residues Asn and Gln; exchange of the basic residues Lys and Arg; and replacements among the aromatic residues Phe and Tyr. Guidance concerning which amino acid changes are likely to be phenotypically silent are found in Bowie et al., Science 247:1306-1310 (1990).

Variant CAT peptides can be fully functional or can lack function in one or more activities, e.g. ability to bind substrate, ability to phosphorylate substrate, ability to mediate signaling, etc. Fully functional variants typically contain only conservative variation or variation in non-critical residues or in non-critical regions.

Non-functional variants typically contain one or more non-conservative amino acid substitutions, deletions, insertions, inversions, or truncation or a substitution, insertion, inversion, or deletion in a critical residue or critical region.

Amino acids that are essential for function can be identified by methods known in the art, such as site-directed mutagenesis or alanine-scanning mutagenesis (Cunningham et al., Science 244:1081-1085 (1989)). The latter procedure introduces single alanine mutations at every residue in the molecule. The resulting mutant molecules are then tested for biological activity such as CAT activity or in assays such as an in vitro proliferative activity. Sites that are critical for binding partner/substrate binding can also be determined by structural analysis such as crystallization, nuclear magnetic resonance or photoaffinity labeling (Smith et al., J. Mol. Biol. 224:899-904 (1992); de Vos et al. Science 255:306-312 (1992)).

The present invention further provides fragments of CAT, in addition to and peptides that comprise and consist of such fragments. As used herein, a fragment comprises at least 8, 10, 12, 14, 16, 18, 20 or more contiguous amino acid residues of a CAT protein. Such fragments can be chosen based on the ability to retain one or more of the biological activities of a CAT or could be chosen for the ability to perform a function, e.g. bind a substrate or act as an immunogen. Particularly important fragments are biologically active fragments, peptides that are, for example, about 8 or more amino acids in length. Such fragments will typically comprise a domain or motif of a CAT, e.g., active site, a transmembrane domain or a substrate-binding domain. Further, possible fragments include, but are not limited to, domain or motif containing fragments, soluble peptide fragments, and fragments containing immunogenic structures. Predicted domains and functional sites are readily identifiable by computer programs well known and readily available to those of skill in the art (e.g., PROSITE analysis).

Polypeptides often contain amino acids other than the 20 amino acids commonly referred to as the 20 naturally occurring amino acids. Further, many amino acids, including the terminal amino acids, may be modified by natural processes, such as processing and other post-translational modifications, or by chemical modification techniques well known in the art. Common modifications that occur naturally in CAT are described in basic texts, detailed monographs, and the research literature, and they are well known to those of skill in the art.

Known modifications include, but are not limited to, acetylation, acylation, ADP-ribosylation, amidation, covalent attachment of flavin, covalent attachment of a heme moiety, covalent attachment of a nucleotide or nucleotide derivative, covalent attachment of a lipid or lipid derivative, covalent attachment of phosphotidylinositol, cross-linking, cyclization, disulfide bond formation, demethylation, formation of covalent crosslinks, formation of cystine, formation of pyroglutamate, formylation, gamma carboxylation, glycosylation, GPI anchor formation, hydroxylation, iodination, methylation, myristoylation, oxidation, proteolytic processing, phosphorylation, prenylation, racemization, selenoylation, sulfation, transfer-RNA mediated addition of amino acids to proteins such as arginylation, and ubiquitination.

Such modifications are well known to those of skill in the art and have been described in great detail in the scientific literature. Several particularly common modifications, glycosylation, lipid attachment, sulfation, gamma-carboxylation of glutamic acid residues, hydroxylation and ADP-ribosylation, for instance, are described in most basic texts, such as Proteins—Structure and Molecular Properties, 2nd Ed., T. E. Creighton, W. H. Freeman and Company, New York (1993). Many detailed reviews are available on this subject, such as by Wold, F., Posttranslational Covalent Modification of Proteins, B. C. Johnson, Ed., Academic Press, New York 1-12 (1983); Seifter et al. (Meth. Enzymol. 182: 626-646 (1990)) and Rattan et al. (Ann. N.Y. Acad. Sci. 663:48-62 (1992)).

Accordingly, CAT proteins of the present invention also encompass derivatives or analogs in which a substituted amino acid residue is not one encoded by the genetic code, in which a substituent group is included, in which a mature CAT is fused with another compound, such as a compound to increase the half-life of a CAT (for example, polyethylene glycol), or in which the additional amino acids are fused to a mature CAT, such as a leader or secretory sequence or a sequence for purification of a mature CAT or a pro-protein sequence.

2. Antibodies against CAT Protein or Fragments Thereof

Antibodies that selectively bind to a CAT protein or peptides of the present invention can be made using standard procedures known to those of ordinary skills in the art. The term "antibody" is used in the broadest sense, and specifically covers monoclonal antibodies (including full length monoclonal antibodies), polyclonal antibodies, multispecific antibodies (e.g., bispecific antibodies), humanized antibody and antibody fragments (e.g., Fab, F(ab').sub.2 and Fv) so long as they exhibit the desired biological activity. Antibodies (Abs) and immunoglobulins (Igs) are glycoproteins having the same structural characteristics. While antibodies exhibit binding specificity to a specific antigen, immunoglobulins include both antibodies and other antibody-like molecules that lack antigen specificity.

As used herein, antibodies are usually heterotetrameric glycoproteins of about 150,000 daltons, composed of two identical light (L) chains and two identical heavy (H) chains. Each light chain is linked to a heavy chain by one covalent disulfide bond, while the number of disulfide linkages varies between the heavy chains of different immunoglobulin isotypes. Each heavy and light chain also has regularly spaced intrachain disulfide bridges. Each heavy chain has at one end a variable domain (VH) followed by a number of constant domains. Each light chain has a variable domain at one end (VL) and a constant domain at its other end. The constant domain of the light chain is aligned with the first constant domain of the heavy chain, and the light chain variable domain is aligned with the variable domain of the heavy chain. Particular amino acid residues are believed to form an interface between the light and heavy chain variable domains. Chothia et al., J. Mol. Biol. 186, 651-63 (1985); Novotny and Haber, Proc. Natl. Acad. Sci. USA 82 4592-4596 (1985).

An "isolated" antibody is one which has been identified and separated and/or recovered from a component of the environment in which it is produced. Contaminant components of its production environment are materials that would interfere with diagnostic or therapeutic uses for the antibody, and may include enzymes, hormones, and other proteinaceous or nonproteinaceous solutes. In preferred embodiments, the antibody will be purified as measurable by at least three different methods: 1) to greater than 95% by weight of antibody as determined by the Lowry method, and most preferably more than 99% by weight; 2) to a degree sufficient to obtain at least 15 residues of N-terminal or internal amino acid sequence by use of a spinning cup sequenator; or 3) to homogeneity by SDS-PAGE under reducing or non-reducing conditions using Coomasie blue or, preferably, silver stain. Isolated antibody includes the antibody in situ within recombinant cells since at least one component of the antibody's natural environment will not be present. Ordinarily, however, isolated antibody will be prepared by at least one purification step.

An "antigenic region" or "antigenic determinant" or an "epitope" includes any protein determinant capable of specific binding to an antibody. This is the site on an antigen to which each distinct antibody molecule binds. Epitopic determinants usually consist of active surface groupings of molecules such as amino acids or sugar side chains and usually have specific three-dimensional structural characteristics, as well as charge characteristics.

"Antibody specificity," is an antibody, which has a stronger binding affinity for an antigen from a first subject species than it has for a homologue of that antigen from a second subject species. Normally, the antibody "bind specifically" to a human antigen (i.e., has a binding affinity (Kd) value of no more than about $1\times10^{-7}$ M, preferably no more than about $1\times10^{-8}$ M and most preferably no more than about $1\times10^{-9}$ M) but has a binding affinity for a homologue of the antigen from a second subject species which is at least about 50 fold, or at least about 500 fold, or at least about 1000 fold, weaker than its binding affinity for the human antigen. The antibody can be of any of the various types of antibodies as defined above, but preferably is a humanized or human antibody (Queen et al., U.S. Pat. Nos. 5,530,101; 5,585,089; 5,693,762; and 6,180,370).

The present invention provides an "antibody variant," which refers to an amino acid sequence variant of an antibody wherein one or more of the amino acid residues have been modified. Such variant necessarily have less than 100% sequence identity or similarity with the amino acid sequence having at least 75% amino acid sequence identity or similarity with the amino acid sequence of either the heavy or light chain variable domain of the antibody, more preferably at least 80%, more preferably at least 85%, more preferably at least 90%, and most preferably at least 95%. Since the method of the invention applies equally to both polypeptides, antibodies and fragments thereof, these terms are sometimes employed interchangeably.

The term "antibody fragment" refers to a portion of a full-length antibody, generally the antigen binding or variable region. Examples of antibody fragments include Fab, Fab', $F(ab')_2$ and Fv fragments. Papain digestion of antibodies produces two identical antigen binding fragments, called the Fab fragment, each with a single antigen binding site, and a residual "Fc" fragment, so-called for its ability to crystallize readily. Pepsin treatment yields an $F(ab')_2$ fragment that has two antigen binding fragments which are capable of crosslinking antigen, and a residual other fragment (which is termed pFc'). Additional fragments can include diabodies, linear antibodies, single-chain antibody molecules, and multispecific antibodies formed from antibody fragments. As used herein, "functional fragment" with respect to antibodies, refers to Fv, F(ab) and $F(ab')_2$ fragments.

An "Fv" fragment is the minimum antibody fragment that contains a complete antigen recognition and binding site. This region consists of a dimer of one heavy and one light chain variable domain in a tight, non-covalent association ($V_H$-$V_L$ dimer). It is in this configuration that the three CDRs of each variable domain interact to define an antigen-binding site on the surface of the $V_H$-$V_L$ dimer. Collectively, the six CDRs confer antigen-binding specificity to the antibody. However, even a single variable domain (or half of an Fv comprising only three CDRs specific for an antigen) has the ability to recognize and bind antigen, although at a lower affinity than the entire binding site.

The Fab fragment [also designated as F(ab)] also contains the constant domain of the light chain and the first constant domain (CH1) of the heavy chain. Fab' fragments differ from Fab fragments by the addition of a few residues at the carboxyl terminus of the heavy chain CH1 domain including one or more cysteines from the antibody hinge region. Fab'-SH is the designation herein for Fab' in which the cysteine residue(s) of the constant domains have a free thiol group. F(ab') fragments are produced by cleavage of the disulfide bond at the hinge cysteines of the $F(ab')_2$ pepsin digestion product. Additional chemical couplings of antibody fragments are known to those of ordinary skill in the art.

The present invention further provides monoclonal antibody, polyclonal antibody as well as humanized antibody. In general, to generate antibodies, an isolated peptide is used as an immunogen and is administered to a mammalian organism, such as a rat, rabbit or mouse. The full-length protein, an antigenic peptide fragment or a fusion protein of a CAT protein can be used. Particularly important fragments are those covering functional domains. Many methods are known for generating and/or identifying antibodies to a given target peptide. Several such methods are described by Harlow, Antibodies, Cold Spring Harbor Press, (1989).

The term "monoclonal antibody" as used herein refers to an antibody obtained from a population of substantially homogeneous antibodies, i.e., the individual antibodies comprising the population are identical except for possible naturally occurring mutations that may be present in minor amounts. Monoclonal antibodies are highly specific, being directed against a single antigenic site. Furthermore, in contrast to conventional (polyclonal) antibody preparations which typically include different antibodies directed against different determinants (epitopes), each monoclonal antibody is directed against a single determinant on the antigen. In additional to their specificity, the monoclonal antibodies are advantageous in that they are synthesized by the hybridoma culture, uncontaminated by other immunoglobulins. The modifier "monoclonal" antibody indicates the character of the antibody as being obtained from a substantially homogeneous population of antibodies, and is not to be construed as requiring production of the antibody by any particular method. For example, the monoclonal antibodies to be used in accordance with the present invention may be made by the hybridoma method first described by Kohler and Milstein, Nature 256, 495 (1975), or may be made by recombinant methods, e.g., as described in U.S. Pat. No. 4,816,567. The monoclonal antibodies for use with the present invention may also be isolated from phage antibody libraries using the techniques described in Clackson et al., Nature 352: 624-628 (1991), as well as in Marks et al., J. Mol. Biol. 222: 581-597 (1991). For detailed procedures for making a monoclonal antibody, see the Example below.

"Humanized" forms of non-human (e.g. murine or rabbit) antibodies are chimeric immunoglobulins, immunoglobulin chains or fragments thereof (such as Fv, Fab, Fab', F(ab') .sub.2 or other antigen-binding subsequences of antibodies) which contain minimal sequence derived from non-human immunoglobulin. For the most part, humanized antibodies are human immunoglobulins (recipient antibody) in which residues from a complementary determining region (CDR) of the recipient are replaced by residues from a CDR of a non-human species (donor antibody) such as mouse, rat or rabbit having the desired specificity, affinity and capacity. In some instances, Fv framework residues of the human immunoglobulin are replaced by corresponding non-human residues. Furthermore, humanized antibody may comprise residues, which are found neither in the recipient antibody nor in the imported CDR or framework sequences. These modifications are made to further refine and optimize antibody performance. In general, the humanized antibody will comprise substantially all of at least one, and typically two, variable domains, in which all or substantially all of the CDR regions correspond to those of a non-human immunoglobulin and all or substantially all of the FR regions are those of a human immunoglobulin consensus sequence. The humanized antibody optimally also will comprise at least a portion of an immunoglobulin constant region (Fc), typically that of a human immunoglobulin. For further details, see: Jones et al., Nature 321, 522-525 (1986); Reichmann et al., Nature 332, 323-327 (1988) and Presta, Curr. Op. Struct. Biol. 2, 593-596 (1992).

Polyclonal antibodies may be prepared by any known method or modifications of these methods including obtaining antibodies from patients. For example, a complex of an immunogen such as a CAT protein, peptides or fragments thereof and a carrier protein is prepared and an animal is immunized by the complex according to the same manner as that described with respect to the above monoclonal antibody preparation and the description in the Example. A serum or plasma containing the antibody against the protein is recovered from the immunized animal and the antibody is separated and purified. The gamma globulin fraction or the IgG antibodies can be obtained, for example, by use of saturated ammonium sulfate or DEAE SEPHADEX, or other techniques known to those skilled in the art.

The antibody titer in the antiserum can be measured according to the same manner as that described above with respect to the supernatant of the hybridoma culture. Separation and purification of the antibody can be carried out according to the same separation and purification method of antibody as that described with respect to the above monoclonal antibody and in the Example.

The protein used herein as the immunogen is not limited to any particular type of immunogen. In one aspect, antibodies are preferably prepared from regions or discrete fragments of a CAT protein. Antibodies can be prepared from any region of the proteins described herein. In particular, the proteins are selected from a group consisting of SEQ ID NOS:1-4, 9, 11-12, 16-19, 24-36, 51-59, 69-74, 81-85, 91-102, 115-116, 119-121, 127-134, 144-145, 148-149, 152-159, 168-174, and 182-183 and fragments thereof. An antigenic fragment will typically comprise at least 8 contiguous amino acid residues. The antigenic peptide can comprise, however, at least 10, 12, 14, 16 or more amino acid residues. Such fragments can be selected on a physical property, such as fragments correspond to regions that are located on the surface of the protein, e.g., hydrophilic regions or can be selected based on sequence uniqueness.

Antibodies may also be produced by inducing production in the lymphocyte population or by screening antibody libraries or panels of highly specific binding reagents as disclosed in Orlandi et al. (1989; Proc Natl Acad Sci 86:3833-3837) or Winter et al. (1991; Nature 349:293-299). A protein may be used in screening assays of phagemid or B-lymphocyte immunoglobulin libraries to identify antibodies having a desired specificity. Numerous protocols for competitive binding or immunoassays using either polyclonal or monoclonal antibodies with established specificities are well known in the art. Smith G. P., 1991, Curr. Opin. Biotechnol. 2: 668-673.

The antibodies of the present invention can also be generated using various phage display methods known in the art. In phage display methods, functional antibody domains are displayed on the surface of phage particles which carry the polynucleotide sequences encoding them. In a particular, such phage can be utilized to display antigen-binding domains expressed from a repertoire or combinatorial antibody library (e.g., human or murine). Phage expressing an antigen binding domain that binds the antigen of interest can be selected or identified with antigen, e.g., using labeled antigen or antigen bound or captured to a solid surface or bead. Phage used in these methods are typically filamentous phage including fd and M13 binding domains expressed from phage with Fab, Fv or disulfide stabilized Fv antibody domains recombinantly fused to either the phage gene III or gene VIII protein. Examples of phage display methods that can be used to make the antibodies of the present invention include those disclosed in Brinkman et al., J. Immunol. Methods 182:41-50 (1995); Ames et al., J. Immunol. Methods 184:177-186 (1995); Kettleborough et al., Eur. J. Immunol. 24:952-958 (1994); Persic et al., Gene 187 9-18 (1997); Burton et al., Advances in Immunology 57:191-280 (1994); PCT application No. PCT/GB91/01134; PCT publications WO 90/02809; WO 91/10737; WO 92/01047; WO 92/18619; WO 93/11236; WO 95/15982; WO 95/20401; and U.S. Pat. Nos. 5,698,426; 5,223,409; 5,403,484; 5,580,717; 5,427,908; 5,750,753; 5,821,047; 5,571,698; 5,427,908; 5,516,637; 5,780,225; 5,658,727; 5,733,743 and 5,969,108; each of which is incorporated herein by reference in its entirety.

Antibody can be also made recombinantly. When using recombinant techniques, the antibody variant can be produced intracellularly, in the periplasmic space, or directly secreted into the medium. If the antibody variant is produced intracellularly, as a first step, the particulate debris, either host cells or lysed fragments, is removed, for example, by centrifugation or ultrafiltration. Carter et al., Bio/Technology 10: 163-167 (1992) describe a procedure for isolating antibodies that are secreted to the periplasmic space of *E. coli*. Briefly, cell paste is thawed in the presence of sodium acetate (pH 3.5), EDTA, and phenylmethylsulfonylfluoride (PMSF) over about 30 minutes. Cell debris can be removed by centrifugation. Where the antibody variant is secreted into the medium, supernatants from such expression systems are generally first concentrated using a commercially available protein concentration filter, for example, an Amicon or Millipore PELLICON ultrafiltration unit. A protease inhibitor such as PMSF may be included in any of the foregoing steps to inhibit proteolysis and antibiotics may be included to prevent the growth of adventitious contaminants.

The antibodies or antigen binding fragments may also be produced by genetic engineering. The technology for expression of both heavy and light chain genes in *E. coli* is the subject the following PCT patent applications; publication number WO 901443, WO901443, and WO 9014424 and in Huse et al., 1989 Science 246:1275-1281. The general recombinant methods are well known in the art.

The antibody composition prepared from the cells can be purified using, for example, hydroxylapatite chromatography, gel electrophoresis, dialysis, and affinity chromatography, with affinity chromatography being the preferred purification technique. The suitability of protein A as an affinity ligand depends on the species and isotype of any immunoglobulin Fc domain that is present in the antibody. Protein A can be used to purify antibodies that are based on human delta.1, .delta.2 or .delta.4 heavy chains (Lindmark et al., J. Immunol Meth. 62: 1-13 (1983)). Protein G is recommended for all mouse isotypes and for human .delta.3 (Guss et al., EMBO J. 5: 1567-1575 (1986)). The matrix to which the affinity ligand is attached is most often agarose, but other matrices are available. Mechanically stable matrices such as controlled pore glass or poly(styrenedivinyl)benzene allow for faster flow rates and shorter processing times than can be achieved with agarose. Where the antibody comprises a CH3 domain, the BAKERBOND ABXTM resin (J. T. Baker, Phillipsburg, N.J.) is useful for purification. Other techniques for protein purification such as fractionation on an ion-exchange column, ethanol precipitation, Reverse Phase HPLC, chromatography on silica, chromatography on heparin SEPHAROSE chromatography on an anion or cation exchange resin (such as a polyaspartic acid column), chromatofocusing, SDS-PAGE, and ammonium sulfate precipitation are also available depending on the antibody to be recovered.

Following any preliminary purification step(s), the mixture comprising the antibody of interest and contaminants may be subjected to low pH hydrophobic interaction chromatography using an elution buffer at a pH between about 2.5-4.5, preferably performed at low salt concentrations (e.g., from about 0-0.25M salt).

3. CAT Nucleic Acid Molecules

Isolated CAT nucleic acid molecules of the present invention consist of, consist essentially of, or comprise a nucleotide sequence that encodes CAT peptides of the present invention, an allelic variant thereof, or an ortholog or paralog thereof. As used herein, an "isolated" nucleic acid molecule is one that is separated from other nucleic acid present in the natural source of the nucleic acid. Preferably, an "isolated" nucleic acid is free of sequences which naturally flank the nucleic acid (i.e., sequences located at the 5' and 3' ends of the nucleic acid) in the genomic DNA of the organism from which the nucleic acid is derived. However, there can be some flanking nucleotide sequences, for example up to about 5 KB, 4 KB, 3 KB, 2 KB, or 1 KB or less, particularly contiguous peptide encoding sequences and peptide encoding sequences within the same gene but separated by introns in the genomic sequence. The important point is that the nucleic acid is isolated from remote and unimportant flanking sequences such that it can be subjected to the specific manipulations described herein such as recombinant expression, preparation of probes and primers, and other uses specific to the nucleic acid sequences.

Moreover, an "isolated" nucleic acid molecule, such as a transcript/cDNA molecule, can be substantially free of other cellular material, or culture medium when produced by recombinant techniques, or chemical precursors or other chemicals when chemically synthesized. However, the nucleic acid molecule can be fused to other coding or regulatory sequences and still be considered isolated.

For example, recombinant DNA molecules contained in a vector are considered isolated. Further examples of isolated DNA molecules include recombinant DNA molecules maintained in heterologous host cells or purified (partially or substantially) DNA molecules in solution. Isolated RNA molecules include in vivo or in vitro RNA transcripts of the isolated DNA molecules of the present invention. Isolated nucleic acid molecules according to the present invention further include such molecules produced synthetically.

The isolated nucleic acid molecules can encode the mature protein plus additional amino or carboxyl-terminal amino acids, or amino acids interior to the mature peptide (when the mature form has more than one peptide chain, for instance). Such sequences may play a role in processing of a protein from precursor to a mature form, facilitate protein trafficking, prolong or shorten protein half-life or facilitate manipulation of a protein for assay or production, among other things. As generally is the case in situ, the additional amino acids may be processed away from the mature protein by cellular enzymes.

As mentioned above, the isolated nucleic acid molecules include, but are not limited to, the sequence encoding a CAT peptide alone, the sequence encoding the mature peptide and additional coding sequences, such as a leader or secretory sequence (e.g., a pre-pro or pro-protein sequence), the sequence encoding the mature peptide, with or without the additional coding sequences, plus additional non-coding sequences, for example introns and non-coding 5' and 3' sequences such as transcribed but non-translated sequences that play a role in transcription, mRNA processing (including splicing and polyadenylation signals), ribosome binding and stability of mRNA. In addition, the nucleic acid molecule may be fused to a marker sequence encoding, for example, a peptide that facilitates purification.

Isolated nucleic acid molecules can be in the form of RNA, such as mRNA, or in the form DNA, including cDNA and genomic DNA obtained by cloning or produced by chemical synthetic techniques or by a combination thereof. The nucleic acid, especially DNA, can be double-stranded or single-stranded. Single-stranded nucleic acid can be the coding strand (sense strand) or the non-coding strand (anti-sense strand).

The invention further provides nucleic acid molecules that encode fragments of the proteins of the present invention as well as nucleic acid molecules that encode obvious variants of a CAT protein of the present invention that are described above. Such nucleic acid molecules may be naturally occurring, such as allelic variants (same locus), paralogs (different locus), and orthologs (different organism), or may be constructed by recombinant DNA methods or by chemical synthesis. Such non-naturally occurring variants may be made by mutagenesis techniques, including those applied to nucleic acid molecules, cells, or organisms. Accordingly, as discussed above, the variants can contain nucleotide substitutions, deletions, inversions and insertions. Variation can occur in either or both the coding and non-coding regions. The variations can produce both conservative and non-conservative amino acid substitutions.

A fragment comprises a contiguous nucleotide sequence greater than 12 or more nucleotides. Further, a fragment could at least 30, 40, 50, 100, 250 or 500 nucleotides in length. The length of the fragment will be based on its intended use. For example, the fragment can encode epitope bearing regions of the peptide, or can be useful as DNA probes and primers. Such fragments can be isolated using the known nucleotide sequence to synthesize an oligonucleotide probe. A labeled probe can then be used to screen a cDNA library, genomic DNA library, or mRNA to isolate nucleic acid corresponding to the coding region. Further, primers can be used in PCR reactions to clone specific regions of gene.

A probe/primer typically comprises substantially a purified oligonucleotide or oligonucleotide pair. The oligonucleotide typically comprises a region of nucleotide sequence that hybridizes under stringent conditions to at least about 12, 20, 25, 40, 50 or more consecutive nucleotides.

Orthologs, homologs, and allelic variants can be identified using methods well known in the art. As described in the Peptide Section, these variants comprise a nucleotide sequence encoding a peptide that is typically 60-70%, 70-80%, 80-90%, and more typically at least about 90-95% or more homologous to the nucleotide sequence. Such nucleic acid molecules can readily be identified as being able to hybridize under moderate to stringent conditions, to the nucleotide sequence shown in the Sequence Listing or a fragment of the sequence. Allelic variants can readily be determined by genetic locus of the encoding gene.

As used herein, the term "hybridizes under stringent conditions" is intended to describe conditions for hybridization and washing under which nucleotide sequences encoding a peptide at least 60-70% homologous to each other typically remain hybridized to each other. The conditions can be such that sequences at least about 60%, at least about 70%, or at least about 80% or more homologous to each other typically remain hybridized to each other. Such stringent conditions are known to those skilled in the art and can be found in Current Protocols in Molecular Biology, John Wiley & Sons, N.Y. (1989), 6.3.1-6.3.6. One example of stringent hybridization conditions is hybridization in 6× sodium chloride/sodium citrate (SSC) at about 45° C., followed by one or more washes in 0.2×SSC, 0.1% SDS at 50-65 C. Examples of moderate to low stringency hybridization conditions are well known in the art.

4. Vectors and Host Cells

The invention also provides vectors containing the nucleic acid molecules described herein. The term "vector" refers to a vehicle, preferably a nucleic acid molecule, which can transport the nucleic acid molecules. When the vector is a nucleic acid molecule, the nucleic acid molecules are covalently linked to the vector nucleic acid. With this aspect of the invention, the vector includes a plasmid, single or double stranded phage, a single or double stranded RNA or DNA viral vector, or artificial chromosome, such as a BAC, PAC, YAC, OR MAC.

A vector can be maintained in the host cell as an extrachromosomal element where it replicates and produces additional copies of the nucleic acid molecules. Alternatively, the vector may integrate into the host cell genome and produce additional copies of the nucleic acid molecules when the host cell replicates.

The invention provides vectors for the maintenance (cloning vectors) or vectors for expression (expression vectors) of the nucleic acid molecules. The vectors can function in prokaryotic or eukaryotic cells or in both (shuttle vectors).

Expression vectors contain cis-acting regulatory regions that are operably linked in the vector to the nucleic acid molecules such that transcription of the nucleic acid molecules is allowed in a host cell. The nucleic acid molecules can be introduced into the host cell with a separate nucleic acid molecule capable of affecting transcription. Thus, the second nucleic acid molecule may provide a trans-acting factor interacting with the cis-regulatory control region to allow transcription of the nucleic acid molecules from the vector. Alternatively, a trans-acting factor may be supplied by the host cell. Finally, a trans-acting factor can be produced from the vector itself. It is understood, however, that in some embodiments, transcription and/or translation of the nucleic acid molecules can occur in a cell-free system.

The regulatory sequences to which the nucleic acid molecules described herein can be operably linked include promoters for directing mRNA transcription. These include, but are not limited to, the left promoter from bacteriophage, the lac, TRP, and TAC promoters from *E. coli*, the early and late promoters from SV40, the CMV immediate early promoter, the adenovirus early and late promoters, and retrovirus long-terminal repeats.

In addition to control regions that promote transcription, expression vectors may also include regions that modulate transcription, such as repressor binding sites and enhancers. Examples include the SV40 enhancer, the cytomegalovirus immediate early enhancer, polyoma enhancer, adenovirus enhancers, and retrovirus LTR enhancers.

In addition to containing sites for transcription initiation and control, expression vectors can also contain sequences necessary for transcription termination and, in the transcribed region a ribosome binding site for translation. Other regulatory control elements for expression include initiation and termination codons as well as polyadenylation signals. The person of ordinary skill in the art would be aware of the numerous regulatory sequences that are useful in expression vectors. Such regulatory sequences are described, for example, in Sambrook et al., Molecular Cloning: A Laboratory Manual. 3rd. ed., Cold Spring Harbor Laboratory Press, Cold Spring Harbor, N.Y., (2001).

A variety of expression vectors can be used to express a nucleic acid molecule. Such vectors include chromosomal, episomal, and virus-derived vectors, for example vectors derived from bacterial plasmids, from bacteriophage, from yeast episomes, from yeast chromosomal elements, including yeast artificial chromosomes, from viruses such as baculoviruses, papovaviruses such as SV40, Vaccinia viruses, adenoviruses, poxviruses, pseudorabies viruses, and retroviruses. Vectors may also be derived from combinations of these sources such as those derived from plasmid and bacteriophage genetic elements, e.g. cosmids and phagemids. Appropriate cloning and expression vectors for prokaryotic and eukaryotic hosts are described in Sambrook et al., Molecular Cloning: A Laboratory Manual. 3rd. ed., Cold Spring Harbor Laboratory Press, Cold Spring Harbor, N.Y., (2001).

The regulatory sequence may provide constitutive expression in one or more host cells (i.e. tissue specific) or may provide for inducible expression in one or more cell types such as by temperature, nutrient additive, or exogenous factor such as a hormone or other ligand. A variety of vectors providing for constitutive and inducible expression in prokaryotic and eukaryotic hosts are well known to those of ordinary skill in the art.

The nucleic acid molecules can be inserted into the vector nucleic acid by well-known methodology. Generally, the DNA sequence that will ultimately be expressed is joined to an expression vector by cleaving the DNA sequence and the expression vector with one or more restriction enzymes and then ligating the fragments together. Procedures for restriction enzyme digestion and ligation are well known to those of ordinary skill in the art.

The vector containing the appropriate nucleic acid molecule can be introduced into an appropriate host cell for propagation or expression using well-known techniques. Bacterial cells include, but are not limited to, *E. coli, Streptomyces*, and *Salmonella typhimurium*. Eukaryotic cells include, but are not limited to, yeast, insect cells such as *Drosophila*, animal cells such as COS and CHO cells, and plant cells.

As described herein, it may be desirable to express the peptide as a fusion protein. Accordingly, the invention provides fusion vectors that allow for the production of the peptides. Fusion vectors can increase the expression of a recombinant protein; increase the solubility of the recombinant protein, and aid in the purification of the protein by acting for example as a ligand for affinity purification. A proteolytic cleavage site may be introduced at the junction of the fusion moiety so that the desired peptide can ultimately be separated from the fusion moiety. Proteolytic enzymes include, but are not limited to, factor Xa, thrombin, and enteroenzyme. Typical fusion expression vectors include pGEX (Smith et al., Gene 67:31-40 (1988)), pMAL (New England Biolabs, Beverly, Mass.) and pRIT5 (Pharmacia, Piscataway, N.J.) which fuse glutathione S-transferase (GST), maltose E binding protein, or protein A, respectively, to the target recombinant protein. Examples of suitable inducible non-fusion *E. coli* expression vectors include pTrc (Amann et al., Gene 69:301-315 (1988)) and pET 11d (Studier et al., Gene Expression Technology: Methods in Enzymology 185:60-89 (1990)).

Recombinant protein expression can be maximized in host bacteria by providing a genetic background wherein the host cell has an impaired capacity to proteolytically cleave the recombinant protein. (Gottesman, S., Gene Expression Technology: Methods in Enzymology 185, Academic Press, San Diego, Calif. (1990) 119-128). Alternatively, the sequence of the nucleic acid molecule of interest can be altered to provide preferential codon usage for a specific host cell, for example *E. coli*. (Wada et al., Nucleic Acids Res. 20:2111-2118 (1992)).

The nucleic acid molecules can also be expressed by expression vectors suitable in a yeast host. Examples of vectors for expression in yeast e.g., *S. cerevisiae* include pYepSec1 (Baldari, et al., EMBO J. 6:229-234 (1987)); pMFa (Kurjan et al., Cell 30:933-943 (1982)), pJRY88 (Schultz et al., Gene 54:113-123 (1987)), and pYES2 (Invitrogen Corporation, San Diego, Calif.).

The nucleic acid molecules can also be expressed in insect cells using, for example, baculovirus expression vectors. Baculovirus vectors available for expression of proteins in cultured insect cells (e.g., Sf 9 cells) include the pAc series (Smith et al., Mol. Cell Biol. 3:2156-2165 (1983)) and the pVL series (Lucklow et al., Virology 170:31-39 (1989)).

In certain embodiments of the invention, the nucleic acid molecules described herein are expressed in mammalian cells using mammalian expression vectors. Examples of mammalian expression vectors include pCDM8 (Seed, B. Nature 329:840 (1987)) and pMT2PC (Kaufman et al., EMBO J. 6:187-195 (1987)).

The expression vectors listed herein are provided by way of example only of the well-known vectors available to those of ordinary skill in the art that would be useful to express the nucleic acid molecules. The person of ordinary skill in the art would be aware of other vectors suitable for maintenance propagation or expression of the nucleic acid molecules described herein. These are found for example in Sambrook, J., Fritsh, E. F., and Maniatis, T. Molecular Cloning: A Laboratory Manual. 3rd. ed., Cold Spring Harbor Laboratory Press, Cold Spring Harbor, N.Y., (2001).

The invention also encompasses vectors in which the nucleic acid sequences described herein are cloned into the vector in reverse orientation, but operably linked to a regulatory sequence that permits transcription of antisense RNA. Thus, an antisense transcript can be produced to all, or to a portion, of the nucleic acid molecule sequences described herein, including both coding and non-coding regions. Expression of this antisense RNA is subject to each of the parameters described above in relation to expression of the sense RNA (regulatory sequences, constitutive or inducible expression, tissue-specific expression).

The invention also relates to recombinant host cells containing the vectors described herein. Host cells therefore include prokaryotic cells, lower eukaryotic cells such as yeast, other eukaryotic cells such as insect cells, and higher eukaryotic cells such as mammalian cells.

The recombinant host cells are prepared by introducing the vector constructs described herein into the cells by techniques readily available to the person of ordinary skill in the art. These include, but are not limited to, calcium phosphate transfection, DEAE-dextran-mediated transfection, cationic lipid-mediated transfection, electroporation, transduction, infection, lipofection, and other techniques such as those found in Sambrook, et al. (Molecular Cloning: A Laboratory Manual. 3rd. ed., Cold Spring Harbor Laboratory Press, Cold Spring Harbor, N.Y., (2001).

Host cells can contain more than one vector. Thus, different nucleotide sequences can be introduced on different vectors of the same cell. Similarly, the nucleic acid molecules can be introduced either alone or with other nucleic acid molecules that are not related to the nucleic acid molecules such as those providing trans-acting factors for expression vectors. When more than one vector is introduced into a cell, the vectors can be introduced independently, co-introduced or joined to the nucleic acid molecule vector.

In the case of bacteriophage and viral vectors, these can be introduced into cells as packaged or encapsulated virus by standard procedures for infection and transduction. Viral vectors can be replication-competent or replication-defective. In the case in which viral replication is defective, replication will occur in host cells providing functions that complement the defects.

Vectors generally include selectable markers that enable the selection of the subpopulation of cells that contain the recombinant vector constructs. The marker can be contained in the same vector that contains the nucleic acid molecules described herein or may be on a separate vector. Markers include tetracycline or ampicillin-resistance genes for prokaryotic host cells and dihydrofolate reductase or neomycin resistance for eukaryotic host cells. However, any marker that provides selection for a phenotypic trait will be effective.

While the mature proteins can be produced in bacteria, yeast, mammalian cells, and other cells under the control of the appropriate regulatory sequences, cell-free transcription and translation systems can also be used to produce these proteins using RNA derived from the DNA constructs described herein.

Where secretion of the peptide is desired, which may be difficult to achieve with a multi-transmembrane domain-containing protein, appropriate secretion signals are incorporated into the vector. The signal sequence can be endogenous to the peptides or heterologous to these peptides.

Where the peptide is not secreted into the medium, the protein can be isolated from the host cell by standard disruption procedures, including freeze thaw, sonication, mechanical disruption, use of lysing agents and the like. The peptide can then be recovered and purified by well-known purification methods including ammonium sulfate precipitation, acid extraction, anion or cationic exchange chromatography, phosphocellulose chromatography, hydrophobic-interaction chromatography, affinity chromatography, hydroxylapatite chromatography, lectin chromatography, or high performance liquid chromatography.

It is also understood that depending upon the host cell in recombinant production of the peptides described herein, the peptides can have various glycosylation patterns, depending upon the cell, or maybe non-glycosylated as when produced in bacteria. In addition, the peptides may include an initial modified methionine in some cases as a result of a host-mediated process.

The recombinant host cells expressing the peptides described herein have a variety of uses. First, the cells are useful for producing CAT proteins or peptides that can be further purified to produce desired amounts of CAT proteins or fragments. Thus, host cells containing expression vectors are useful for peptide production.

Host cells are also useful for conducting cell-based assays involving a CAT protein or CAT protein fragments, such as those described above as well as other formats known in the art. Thus, a recombinant host cell expressing a native CAT protein is useful for assaying compounds that stimulate or inhibit CAT protein function.

Host cells are also useful for identifying CAT protein mutants in which these functions are affected. If the mutants naturally occur and give rise to a pathology, host cells containing the mutations are useful to assay compounds that have a desired effect on the mutant CAT protein (for example, stimulating or inhibiting function) which may not be indicated by their effect on the native CAT protein.

5. Detection and Diagnosis in General

As used herein, a "biological sample" can be collected from tissues, blood, sera, cell lines or biological fluids such as, plasma, interstitial fluid, urine, cerebrospinal fluid, and the like, containing cells. In preferred embodiments, a biological sample comprises cells or tissues suspected of having diseases (e.g., cells obtained from a biopsy).

As used herein, a "differential level" is defined as the level of a CAT protein or nucleic acids in a test sample either above or below the level in control samples, wherein the level of control samples is obtained either from a control cell line, a normal tissue or body fluids, or combination thereof, from a healthy subject. While the protein is overexpressed, the expression of a CAT is preferably greater than about 20%, or preferably greater than about 30%, and most preferably greater than about 50% or more of disease sample, at a level that is at least two fold, and preferably at least five fold, greater than the level of expression in control samples, as determined using a representative assay provided herein. While the protein is under expressed, the expression of a CAT is preferably less than about 20%, or preferably less than 30%, and most preferably less than about 50% or more of the disease sample, at a level that is at least 0.5 fold, and preferably at least 0.2 fold less than the level of the expression in control samples, as determined using a representative assay provided herein.

As used herein, a "subject" can be a mammalian subject or non mammalian subject, preferably, a mammalian subject. A mammalian subject can be human or non-human, preferably human. A healthy subject is defined as a subject without detectable diseases or associated pathologies by using conventional diagnostic methods.

As used herein, the "disease(s)" preferably include cancer and associated diseases and pathologies.

6. Treatment in General

This invention further pertains to novel agents identified by the screening assays described below. It is also within the scope of this invention to use an agent identified for treatment purposes. For example, an agent identified as described herein (e.g., a CAT-modulating agent, an antisense CAT nucleic acid molecule, a CAT-RNAi fragment, a CAT-specific antibody, or a CAT-binding partner) can be used in an animal or other model to determine the efficacy, toxicity, or side effects of treatment with such an agent. Alternatively, an agent identified as described herein can be used in an animal or other model to determine the mechanism of action of such an agent. Furthermore, this invention pertains to uses of novel agents identified by the above-described screening assays for treatments as described herein.

Modulators of CAT protein activity identified according to these drug screening assays can be used to treat a subject with a disorder mediated by a CAT, e.g., by treating cells or tissues that express a CAT at a differential level. Methods of treatment include the steps of administering a modulator of CAT activity in a pharmaceutical composition to a subject in need of such treatment.

The following terms, as used in the present specification and claims, are intended to have the meaning as defined below, unless indicated otherwise.

"Treat," "treating" or "treatment" of a disease includes: (1) inhibiting the disease, i.e., arresting or reducing the development of the disease or its clinical symptoms, or (2) relieving the disease, i.e., causing regression of the disease or its clinical symptoms.

The term "prophylaxis" is used to distinguish from "treatment," and to encompass both "preventing" and "suppressing," it is not always possible to distinguish between "preventing" and "suppressing," as the ultimate inductive event or events may be unknown, latent, or the patient is not ascertained until well after the occurrence of the event or events. Therefore, the term "protection," as used herein, is meant to include "prophylaxis."

A "therapeutically effective amount" means the amount of an agent that, when administered to a subject for treating a disease, is sufficient to effect such treatment for the disease. The "therapeutically effective amount" will vary depending on the agent, the disease and its severity and the age, weight, etc., of the subject to be treated.

In one embodiment, when decreased expression or activity of the protein is desired, an inhibitor, antagonist, antibody and the like or a pharmaceutical agent containing one or more of these molecules may be delivered. Such delivery may be effected by methods well known in the art and may include delivery by an antibody specifically targeted to the protein.

In another embodiment, when increased expression or activity of the protein is desired, the protein, an agonist, an enhancer and the like or a pharmaceutical agent containing one or more of these molecules may be delivered. Such delivery may be effected by methods well known in the art.

While it is possible for the modulating agent to be administered in a pure or substantially pure form, it is preferable to present it as a pharmaceutical composition, formulation or preparation with a carrier. The formulations of the present invention, both for veterinary and for human use, comprise a suitable active CAT modulating agent, together with one or more pharmaceutically acceptable carriers and, optionally, other therapeutic ingredients. The carrier(s) must be "acceptable" in the sense of being compatible with the other ingredients of the formulation and not deleterious to the recipient thereof. The formulations may conveniently be presented in unit dosage form and may be prepared by any method well-known in the pharmaceutical art.

Suitable pharmaceutical carriers include proteins such as albumins (e.g., U.S. Pat. No. 4,507,234, to Kato et al.), peptides and polysaccharides such as aminodextran (e.g., U.S. Pat. No. 4,699,784, to Shih et al.), or water. A carrier may also bear an agent by noncovalent bonding or by encapsulation, such as within a liposome vesicle (e.g., U.S. Pat. Nos. 4,429,008 and 4,873,088). Carriers specific for radionuclide agents include radiohalogenated small molecules and chelating compounds. For example, U.S. Pat. No. 4,735,792 discloses representative radiohalogenated small molecules and their synthesis. A radionuclide chelate may be formed from chelating compounds that include those containing nitrogen and sulfur atoms as the donor atoms for binding the metal, metal oxide, radionuclide. For example, U.S. Pat. No. 4,673,562, to Davison et al. discloses representative chelating compounds and their synthesis.

All methods include the step of bringing into association the active ingredient with the carrier, which constitutes one or more accessory ingredients. In general, the formulations are prepared by uniformly and intimately bringing into association the active ingredient with liquid carriers or finely divided solid carriers or both, and then, if necessary, shaping the product into the desired formulation.

Formulations suitable for intravenous intramuscular, subcutaneous, or intraperitoneal administration conveniently comprise sterile aqueous solutions of the active ingredient with solutions, which are preferably isotonic with the blood of the recipient. Such formulations may be conveniently prepared by dissolving solid active ingredient in water containing physiologically compatible substances such as sodium chloride (e.g. 0.1-2.0M), glycine, and the like, and having a buffered pH compatible with physiological conditions to produce an aqueous solution, and rendering said solution sterile. These may be present in unit or multi-dose containers, for example, sealed ampoules or vials.

The formulations of the present invention may incorporate a stabilizer. Illustrative stabilizers are polyethylene glycol, proteins, saccharides, amino acids, inorganic acids, and organic acids, which may be used either on their own or as admixtures. These stabilizers are preferably incorporated in an amount of 0.11-10,000 parts by weight per part by weight of immunogen. If two or more stabilizers are to be used, their total amount is preferably within the range specified above. These stabilizers are used in aqueous solutions at the appropriate concentration and pH. The specific osmotic pressure of such aqueous solutions is generally in the range of 0.1-3.0 osmoles, preferably in the range of 0.8-1.2. The pH of the aqueous solution is adjusted to be within the range of 5.0-9.0, preferably within the range of 6-8. In formulating the antibody of the present invention, anti-adsorption agent may be used.

Additional pharmaceutical methods may be employed to control the duration of action. Controlled release preparations may be achieved through the use of polymer to complex or absorb the proteins or their derivatives. The controlled delivery may be exercised by selecting appropriate macromolecules (for example polyester, polyamino acids, polyvinyl, pyrrolidone, ethylenevinylacetate, methylcellulose, carboxymethylcellulose, or protamine sulfate) and the concentration of macromolecules as well as the methods of incorporation in order to control release. Another possible method to control the duration of action by controlled-release preparations is to incorporate an anti-CAT antibody into particles of a polymeric material such as polyesters, polyamino acids, hydrogels, poly(lactic acid) or ethylene vinylacetate copolymers. Alternatively, instead of incorporating these agents into polymeric particles, it is possible to entrap these materials in microcapsules prepared, for example, by coacervation techniques or by interfacial polymerization, for example, hydroxymethylcellulose or gelatin-microcapsules and poly (methylmethacylate) microcapsules, respectively, or in colloidal drug delivery systems, for example, liposomes, albumin microspheres, microemulsions, nanoparticles, and nanocapsules or in macroemulsions.

When oral preparations are desired, the compositions may be combined with typical carriers, such as lactose, sucrose, starch, talc magnesium stearate, crystalline cellulose, methyl cellulose, carboxymethyl cellulose, glycerin, sodium alginate or gum arabic among others.

7. Diagnosis, Treatment and Screening Methods Using CAT Nucleic Acids a. General Aspects The nucleic acid molecules of the present invention are useful for probes, primers, chemical intermediates, and in biological assays. The nucleic acid molecules are useful as hybridization probes for messenger RNA, transcript/cDNA, and genomic DNA, such as to detect or isolate full-length cDNA and genomic clones encoding CAT protein or peptide of the invention, or variants thereof.

The probes can correspond to any sequence along the entire length of the nucleic acid molecules of SEQ ID NOS:5-8, 10, 13-15, 20-23, 37-50, 60-68, 75-80, 86-90, 103-114, 117-118, 122-126, 135-143, 146-147, 150-151, 160-167, 175-181, 184-185. Accordingly, it could be derived from 5' noncoding regions, the coding region, and 3' noncoding regions.

The nucleic acid molecules are also useful as primers for PCR to amplify any given region of a nucleic acid molecule and are useful to synthesize antisense molecules of desired length and sequence.

The nucleic acid molecules are also useful for constructing recombinant vectors. Such vectors include expression vectors that express a portion of, or all of, the peptide sequences. The nucleic acid molecules are also useful for expressing antigenic portions of the proteins.

The nucleic acid molecules are also useful for designing ribozymes corresponding to all, or a part, of the mRNA produced from the nucleic acid molecules described herein.

The nucleic acid molecules are also useful for constructing host cells expressing a part, or all, of the nucleic acid molecules and peptides.

The nucleic acid molecules are also useful for constructing transgenic animals expressing all, or a part, of the nucleic acid molecules and peptides.

In vitro techniques for detection of mRNA include Northern hybridizations and in situ hybridizations. In vitro techniques for detecting DNA include Southern hybridizations and in situ hybridization.

b. Diagnosis Methods

The nucleic acid molecules are also useful as hybridization probes for determining the presence, level, form and distribution of nucleic acid expression. The probes can be used to detect the presence of, or to determine levels of, a specific nucleic acid molecule in cells, tissues, and in organisms. Accordingly, probes corresponding to the peptides described herein can be used to assess expression and/or gene copy number in a given cell, tissue, or organism. These uses are relevant for diagnosis of disorders involving an increase or decrease in CAT protein expression relative to normal results.

Probes can be used as a part of a diagnostic test kit for identifying cells or tissues that express CAT protein differentially, such as by measuring a level of a CAT-encoding nucleic acid in a sample of cells from a subject e.g., mRNA or genomic DNA, or determining if a CAT gene has been mutated.

The invention also encompasses kits for detecting the presence of CAT nucleic acid in a biological sample. For example, the kit can comprise reagents such as a labeled or labelable nucleic acid or agent capable of detecting CAT nucleic acid in a biological sample; means for determining the amount of CAT nucleic acid in the sample; and means for comparing the amount of CAT nucleic acid in the sample with a standard. The compound or agent can be packaged in a suitable container. The kit can further comprise instructions for using the kit to detect CAT protein mRNA or DNA.

c. Screening Method Using Nucleic Acids

Nucleic acid expression assays are useful for drug screening to identify compounds that modulate CAT nucleic acid expression.

The invention thus provides a method for identifying a compound that can be used to treat a disease associated with differential expression of a CAT gene, particularly cancer. The method typically includes assaying the ability of the compound to modulate the expression of CAT nucleic acid and thus identifying a compound that can be used to treat a disorder characterized by undesired CAT nucleic acid expression. The assays can be performed in cell-based and cell-free systems. Cell-based assays include cells naturally expressing CAT nucleic acid or recombinant cells genetically engineered to express specific nucleic acid sequences.

The assay for CAT nucleic acid expression can involve direct assay of nucleic acid levels, such as mRNA levels, or on collateral compounds involved in the signal pathway. Further, the expression of genes that are up- or down-regulated in response to a CAT protein signal pathway can also be assayed. In this embodiment the regulatory regions of these genes can be operably linked to a reporter gene such as luciferase.

Thus, modulators of CAT gene expression can be identified in a method wherein a cell is contacted with a candidate compound or agent and the expression of mRNA determined. The level of expression of CAT mRNA in the presence of the candidate compound or agent is compared to the level of expression of CAT mRNA in the absence of the candidate compound or agent. The candidate compound can then be identified as a modulator of nucleic acid expression based on this comparison and be used, for example to treat a disorder characterized by aberrant nucleic acid expression. When expression of mRNA is statistically significantly greater in the presence of the candidate compound than in its absence, the candidate compound is identified as a stimulator of nucleic acid expression. When nucleic acid expression is statistically significantly less in the presence of the candidate compound than in its absence, the candidate compound is identified as an inhibitor of nucleic acid expression.

d. Methods of Monitoring Treatment

The nucleic acid molecules are also useful for monitoring the effectiveness of modulating compounds or agents on the expression or activity of a CAT gene in clinical trials or in a treatment regimen. Thus, the gene expression pattern can serve as a barometer for the continuing effectiveness of treatment with the compound, particularly with compounds to which a patient can develop resistance. The gene expression pattern can also serve as a marker indicative of a physiological response of the affected cells to the compound. Accordingly, such monitoring would allow either increased administration of the compound or the administration of alternative compounds to which the patient has not become resistant. Similarly, if the level of nucleic acid expression falls below a desirable level, administration of the compound could be commensurately decreased.

e. Treatment Using Nucleic Acid

The nucleic acid molecules are useful to design antisense constructs to control CAT gene expression in cells, tissues, and organisms. A DNA antisense nucleic acid molecule is designed to be complementary to a region of the gene involved in transcription, preventing transcription and hence production of CAT protein. An antisense RNA or DNA nucleic acid molecule would hybridize to the mRNA and thus block translation of mRNA into CAT protein.

The nucleic acid of the present invention may also be used to specifically suppress gene expression by methods such as RNA interference (RNAi), which may also include cosuppression and quelling. This and antisense RNA or DNA of gene suppression are well known in the art. A review of this technique is found in Science 288:1370-1372, 2000. RNAi also operates on a post-transcriptional level and is sequence specific, but suppresses gene expression far more efficiently than antisense RNA. RNAi fragments, particularly double-stranded (ds) RNAi, can be also used to generate loss-of-function phenotypes.

The present invention relates to isolated RNA molecules (double-stranded; single-stranded) of from about 21 to about 25 nucleotides which mediate RNAi. As used herein, about 21 to about 25 nt includes nucleotides 17, 18, 19, 20, 21, 22, 23, 24, 25, 26, 27, 28 and 29 nucleotides in length. The isolated RNAs of the present invention mediate degradation of mRNA, the transcriptional product of a gene. Such mRNA is also referred to herein as mRNA to be degraded. As used herein, the terms RNA, RNA molecule(s), RNA segment(s) and RNA fragment(s) are used interchangeably to refer to RNA that mediates RNA interference. These terms include double-stranded RNA, single-stranded RNA, isolated RNA (partially purified RNA, essentially pure RNA, synthetic RNA, recombinantly produced RNA), as well as altered RNA that differs from naturally occurring RNA by the addition, deletion, substitution and/or alteration of one or more nucleotides. Such alterations can include addition of non-nucleotide material, such as to the end(s) of the 21-25 nt RNA or internally (at one or more nucleotides of the RNA). Nucleotides in the RNA molecules of the present invention can also comprise non-standard nucleotides, including non-naturally occurring nucleotides or deoxyribonucleotides. Collectively, all such altered RNAs are referred to as analogs or analogs of naturally-occurring RNA. RNA of 21-25 nucleotides of the present invention need only be sufficiently similar to natural RNA that it has the ability to mediate RNAi. As used herein the phrase "mediates RNAi" refers to the ability to distinguish which RNAs are to be degraded by the RNAi machinery or process. RNA that mediates RNAi interacts with the RNAi machinery such that it directs the degradation of particular mRNAs. Such RNA may include RNAs of various structure, including short hairpin RNA.

In one embodiment, the present invention relates to RNA molecules of about 21 to about 25 nucleotides that direct cleavage of specific mRNA to which their sequence corresponds. It is not necessary that there be perfect correspondence of the sequences, but the correspondence must be sufficient to enable the RNA to direct RNAi cleavage of the target mRNA (Holen et al. (2005) Nucleic Acids Res. 33, 4704-4710). In a particular embodiment, the 21-25 nt RNA molecules of the present invention comprise a 3' hydroxyl group.

The present invention relates to 21-25 nt RNAs of specific genes, produced by chemical synthesis or recombinant DNA techniques, that mediate RNAi. As used herein, the term isolated RNA includes RNA obtained by any means, including processing or cleavage of dsRNA; production by chemical synthetic methods; and production by recombinant DNA techniques. The invention further relates to uses of the 21-25 nt RNAs, such as for therapeutic or prophylactic treatment and compositions comprising 21-25 nt RNAs that mediate RNAi, such as pharmaceutical compositions comprising 21-25 nt RNAs and an appropriate carrier.

The present invention also relates to a method of mediating RNA interference of genes of a patient. In one embodiment, RNA of about 21 to about 25 nt which targets the specific mRNA to be degraded is introduced into a patient's cells. The cells are maintained under conditions allowing degradation of the mRNA, resulting in RNA-mediated interference of the mRNA of the gene in the cells of the patient. Treatment of patients with cancer with the RNAi will inhibit the growth and spread of the cancer and reduce the tumor. Treatment of patients using RNAi can also be in combination with other anti-cancer compounds. The RNAi may be used in combination with other treatment modalities, such as chemotherapy, cryotherapy, hyperthermia, radiation therapy, and other similar treatments. In one embodiment, a chemotherapy agent was combined with the RNAi. In another embodiment, a chemotherapy named Gemzar was used.

Treatment of cancer or tumors in patients requires introduction of the RNA into the cancer or tumor cells. RNA may be directly introduced into the cell, or introduced extracellularly into a cavity, interstitial space, into the circulation of a patient, or introduced orally. Methods for oral introduction include direct mixing of the RNA with food, as well as engineered approaches in which a species that is used as food is engineered to express the RNA and then ingested. Physical methods of introducing nucleic acids, for example, injection directly into the cell or extracellular injection into the patient, may also be used. Vascular or extravascular circulation, the blood or lymph system, and the cerebrospinal fluid are sites where the RNA may be introduced. RNA may be introduced into an embryonic stem cell, or another multipotent cell derived from the patient. Physical methods of introducing nucleic acids include injection of a solution containing the RNA, bombardment by particles covered by the RNA, soaking cells or tissue in a solution of the RNA, or electroporation of cell membranes in the presence of the RNA. A viral construct packaged into a viral particle may be used to introduce an expression construct into the cell, with the construct expressing RNA. Other methods known in the art for introducing nucleic acids to cells may be used, such as lipid-mediated carrier transport, chemical-mediated transport, and the like. Thus the RNA may be introduced along with components that perform one or more of the following activities: enhance RNA uptake by the cell, promote annealing of the duplex strands, stabilize the annealed strands, or otherwise increase inhibition of the target gene. The RNAi may be used in combination with other treatment modalities, such as chemotherapy, cryotherapy, hyperthermia, radiation therapy, and the like.

The present invention may be used alone or as a component of a kit having at least one of the reagents necessary to carry out the in vitro or in vivo introduction of RNA to tissue or patients. Preferred components are the dsRNA and a vehicle that promotes introduction of the dsRNA. Such a kit may also include instructions to allow a user of the kit to practice the invention.

Alternatively, a class of antisense molecules can be used to inactivate mRNA in order to decrease expression of CAT nucleic acid. Accordingly, these molecules can treat a disorder characterized by abnormal or undesired CAT nucleic acid expression. This technique involves cleavage by means of ribozymes containing nucleotide sequences complementary to one or more regions in the mRNA that attenuate the ability of the mRNA to be translated. Possible regions include coding regions and particularly coding regions corresponding to the catalytic and other functional activities of a CAT protein, such as substrate binding.

The nucleic acid molecules can be used for gene therapy in patients containing cells that are aberrant in CAT gene expression. Thus, recombinant cells, which include the patient's cells that have been engineered ex vivo and returned to the patient, are introduced into an individual where the cells produce a desired CAT protein to treat the individual.

8. Diagnosis Using CAT Protein

Protein Detections

The present invention provides methods for diagnosing or detecting the differential presence of a CAT protein. Where a CAT is overexpressed in diseased cells, CAT protein can be detected directly.

The information obtained is also used to determine prognosis and appropriate course of treatment. For example, it is contemplated that individuals with a specific CAT expression or stage of disease may respond differently to a given treatment that individuals lacking CAT expression. The information obtained from the diagnostic methods of the present invention thus provides for the personalization of diagnosis and treatment.

In one embodiment, the present invention provides a method for monitoring disease treatment in a subject comprising: determining the level of a CAT protein or any fragment(s) or peptide(s) thereof in a test sample from said subject, wherein a level of said CAT protein similar to the level of said protein in a test sample from a healthy subject, or the level established for a healthy subject, is indicative of successful treatment.

In another embodiment, the present invention provides a method for diagnosing recurrence of disease following successful treatment in a subject comprising: determining the level of a CAT protein or any fragment(s) or peptide(s) thereof in a test sample from said subject; wherein a changed level of said CAT protein relative to the level of said protein in a test sample from a healthy subject, or the level established for a healthy subject, is indicative of recurrence of diseases.

In yet another embodiment, the present invention provides a method for diagnosing or detecting disease in a subject comprising: determining the level of a CAT protein or any fragment or peptides thereof in a test sample from said subject; wherein a differential level of said CAT protein relative to the level of said protein in a test sample from a healthy subject, or the level established for a healthy subject, is indicative of disease.

These methods are also useful for diagnosing diseases that show differential protein expression. As describe earlier, normal, control or standard values or level established from a healthy subject for protein expression are established by combining body fluids or tissue, cell extracts taken from a normal healthy mammalian or human subject with specific antibodies to a protein under conditions for complex formation. Standard values for complex formation in normal and diseased tissues are established by various methods, often photometric means. Then complex formation as it is expressed in a subject sample is compared with the standard values. Deviation from the normal standard and toward the diseased standard provides parameters for disease diagnosis or prognosis while deviation away from the diseased and toward the normal standard may be used to evaluate treatment efficacy.

In yet another embodiment, the present invention provides a detection or diagnostic method of a CAT by using LC/MS. The proteins from cells are prepared by methods known in the art (for example, R. Aebersold Nature Biotechnology, Volume 21, Number 6, June 2003). The differential expression of proteins in disease and healthy samples are quantitated using Mass Spectrometry and ICAT (Isotope Coded Affinity Tag) labeling, which is known in the art. ICAT is an isotope label technique that allows for discrimination between two populations of proteins, such as a healthy and a disease sample. The LC/MS spectra are collected for the labeled samples. The raw scans from the LC/MS instrument are subjected to peak detection and noise reduction software. Filtered peak lists are then used to detect 'features' corresponding to specific peptides from the original sample(s). Features are characterized by their mass/charge, charge, retention time, isotope pattern and intensity.

The intensity of a peptide present in both healthy and disease samples can be used to calculate the differential expression, or relative abundance, of the peptide. The intensity of a peptide found exclusively in one sample can be used to calculate a theoretical expression ratio for that peptide (singleton). Expression ratios are calculated for each peptide of each replicate of the experiment. Thus overexpression or under expression of a CAT protein or peptide are similar to the expression pattern in a test subject indicates the likelihood of having a disease, particularly cancer, or an associated pathology.

Immunological methods for detecting and measuring complex formation as a measure of protein expression using either specific polyclonal or monoclonal antibodies are known in the art. Examples of such techniques include enzyme-linked immunosorbent assays (ELISAs), radioimmunoassays (RIAs), fluorescence-activated cell sorting (FACS) and antibody arrays. Such immunoassays typically involve the measurement of complex formation between the protein and its specific antibody. These assays and their quantitation against purified, labeled standards are well known in the art (Ausubel, supra, unit 10.1-10.6). A two-site, monoclonal-based immunoassay utilizing antibodies reactive to two non-interfering epitopes is preferred, but a competitive binding assay may be employed (Pound (1998) Immunochemical Protocols, Humana Press, Totowa N.J.). More immunological detections are described in section below.

For diagnostic applications, the antibody or its variant typically will be labeled with a detectable moiety. Numerous labels are available which can be generally grouped into the following categories:

(a) Radioisotopes, such as $^{36}S$, $^{14}C$, $^{125}I$, $^{3}H$, and $^{131}I$. The antibody variant can be labeled with the radioisotope using the techniques described in Current Protocols in Immunology, vol 1-2, Coligen et al., Ed., Wiley-Interscience, New York, Pubs. (1991) for example and radioactivity can be measured using scintillation counting.

(b) Fluorescent labels such as rare earth chelates (europium chelates) or fluorescein and its derivatives, rhodamine and its derivatives, dansyl, Lissamine, phycoerythrin and Texas Red are available. The fluorescent labels can be conjugated to the antibody variant using the techniques disclosed in Current Protocols in Immunology, supra, for example. Fluorescence can be quantified using a fluorometer.

(c) Various enzyme-substrate labels are available and U.S. Pat. Nos. 4,275,149 and 4,318,980 provide a review of some of these. The enzyme generally catalyzes a chemical alteration of the chromogenic substrate which can be measured using various techniques. For example, the enzyme may catalyze a color change in a substrate, which can be measured spectrophotometrically. Alternatively, the enzyme may alter the fluorescence or chemiluminescence of the substrate. Techniques for quantifying a change in fluorescence are described above. The chemiluminescent substrate becomes electronically excited by a chemical reaction and may then emit light which can be measured (using a chemiluminometer, for example) or donates energy to a fluorescent acceptor. Examples of enzymatic labels include luciferases (e.g., firefly luciferase and bacterial luciferase; U.S. Pat. No. 4,737,456), luciferin, 2,3-dihydrophthalazinediones, malate dehydrogenase, urease, peroxidase such as horseradish peroxidase (HRPO), alkaline phosphatase, β-galactosidase, glucoamylase, lysozyme, saccharide oxidases (e.g., glucose oxidase, galactose oxidase, and glucose-6-phosphate dehydrogenase), heterocyclic oxidases (such as uricase and xanthine oxidase), lactoperoxidase, microperoxidase, and the like. Techniques for conjugating enzymes to antibodies are described in O'Sullivan et al., Methods for the Preparation of Enzyme-Antibody Conjugates for Use in Enzyme Immunoassay, in Methods in Enzyme. (Ed. J. Langone & H. Van Vunakis), Academic press, New York, 73: 147-166 (1981).

Sometimes, the label is indirectly conjugated with the antibody. The skilled artisan will be aware of various techniques for achieving this. For example, the antibody can be conjugated with biotin and any of the three broad categories of labels mentioned above can be conjugated with avidin, or vice versa. Biotin binds selectively to avidin and thus, the label can be conjugated with the antibody in this indirect manner. Alternatively, to achieve indirect conjugation of the label with the antibody, the antibody is conjugated with a small hapten (e.g. digoxin) and one of the different types of labels mentioned above is conjugated with an anti-hapten antibody (e.g. anti-digoxin antibody). Thus, indirect conjugation of the label with the antibody can be achieved.

The biological samples can then be tested directly for the presence of a CAT by assays (e.g., ELISA or radioimmunoassay) and format (e.g., microwells, dipstick, etc., as described in International Patent Publication WO 93/03367). Alternatively, proteins in the sample can be size separated (e.g., by polyacrylamide gel electrophoresis (PAGE)), in the presence or absence of sodium dodecyl sulfate (SDS), and the presence of CAT detected by immunoblotting (e.g., Western blotting). Immunoblotting techniques are generally more effective with antibodies generated against a peptide corresponding to an epitope of a protein, and hence, are particularly suited to the present invention.

Antibody binding may be detected also by "sandwich" immunoassays, immunoradiometric assays, gel diffusion precipitation reactions, immunodiffusion assays, in situ immunoassays (e.g., using colloidal gold, enzyme or radioisotope labels, for example), precipitation reactions, agglutination assays (e.g., gel agglutination assays, hemagglutination assays, etc.), complement fixation assays, immunofluorescence assays, protein A assays, and immunoelectrophoresis assays, etc.

In one embodiment, antibody binding is detected by detecting a label on the primary antibody. In another embodiment, the primary antibody is detected by detecting binding of a secondary antibody or reagent to the primary antibody. In a further embodiment, the secondary antibody is labeled. Many means are known in the art for detecting binding in an immunoassay and are within the scope of the present invention. As is well known in the art, the immunogenic peptide should be provided free of the carrier molecule used in any immunization protocol. For example, if the peptide is conjugated to KLH, it may be conjugated to BSA, or used directly, in a screening assay. In some embodiments, an automated detection assay is utilized. Methods for the automation of immunoassays are well known in the art (See e.g., U.S. Pat. Nos. 5,885,530, 4,981,785, 6,159,750, and 5,358,691, each of which is herein incorporated by reference). In some embodiments, the analysis and presentation of results is also automated. For example, in some embodiments, software that generates a prognosis based on the presence or absence of a series of antigens is utilized.

Competitive binding assays rely on the ability of a labeled standard to compete with the test sample for binding with a limited amount of antibody. The amount of antigen in the test sample is inversely proportional to the amount of standard that becomes bound to the antibodies. To facilitate determining the amount of standard that becomes bound, the antibodies generally are insolubilized before or after the competition. As a result, the standard and test sample that are bound to the antibodies may conveniently be separated from the standard and test sample, which remain unbound.

Sandwich assays involve the use of two antibodies, each capable of binding to a different immunogenic portion, or epitope, or the protein to be detected. In a sandwich assay, the test sample to be analyzed is bound by a first antibody, which is immobilized on a solid support, and thereafter a second antibody binds to the test sample, thus forming an insoluble three-part complex. See e.g., U.S. Pat. No. 4,376,110. The second antibody may itself be labeled with a detectable moiety (direct sandwich assays) or may be measured using an anti-immunoglobulin antibody that is labeled with a detectable moiety (indirect sandwich assay). For example, one type of sandwich assay is an ELISA assay, in which case the detectable moiety is an enzyme.

The antibodies may also be used for in vivo diagnostic assays. Generally, the antibody is labeled with a radionucleotide (such as $^{111}In$, $^{99}Tc$, $^{14}C$, $^{131}I$, $^{3}H$, $^{32}P$ or $^{35}S$) so that the tumor can be localized using immunoscintiography. In one embodiment, antibodies or fragments thereof bind to the extracellular domains of two or more CAT targets and the affinity value (Kd) is less than $1\times10^{8}$ M.

Antibodies for diagnostic use may be labeled with probes suitable for detection by various imaging methods. Methods for detection of probes include, but are not limited to, fluorescence, light, confocal and electron microscopy; magnetic resonance imaging and spectroscopy; fluoroscopy, computed tomography and positron emission tomography. Suitable probes include, but are not limited to, fluorescein, rhodamine, eosin and other fluorophores, radioisotopes, gold, gadolinium and other lanthanides, paramagnetic iron, fluorine-18 and other positron-emitting radionuclides. Additionally, probes may be bi- or multi-functional and be detectable by more than one of the methods listed. These antibodies may be directly or indirectly labeled with said probes. Attachment of probes to the antibodies includes covalent attachment of the probe, incorporation of the probe into the antibody, and the covalent attachment of a chelating compound for binding of probe, amongst others well recognized in the art.

For immunohistochemistry, the disease tissue sample may be fresh or frozen or may be embedded in paraffin and fixed with a preservative such as formalin (see Example). The fixed or embedded section contains the sample are contacted with a labeled primary antibody and secondary antibody, wherein the antibody is used to detect CAT protein expression in situ. The detailed procedure is shown in the Example.

Antibodies against CAT proteins or peptides are useful to detect the presence of one of the proteins of the present invention in cells or tissues to determine the pattern of expression of the protein among various tissues in an organism and over the course of normal development.

Further, such antibodies can be used to detect protein in situ, in vitro, or in a cell lysate or supernatant in order to evaluate the abundance and pattern of expression. Also, such antibodies can be used to assess abnormal tissue distribution or abnormal expression during development or progression of a biological condition. Antibody detection of circulating fragments of the full length protein can be used to identify turnover.

Further, the antibodies can be used to assess expression in disease states such as in active stages of the disease or in an individual with a predisposition toward disease related to the protein's function. When a disorder is caused by an inappropriate tissue distribution, developmental expression, level of expression of the protein, or expressed/processed form, the antibody can be prepared against the normal protein. If a disorder is characterized by a specific mutation in the protein, antibodies specific for this mutant protein can be used to assay for the presence of the specific mutant protein.

The antibodies can also be used to assess normal and aberrant subcellular localization of cells in the various tissues in an organism. The diagnostic uses can be applied, not only in genetic testing, but also in monitoring a treatment modality. Accordingly, where treatment is ultimately aimed at correcting expression level or the presence of aberrant sequence and aberrant tissue distribution or developmental expression, antibodies directed against the protein or relevant fragments can be used to monitor therapeutic efficacy. More detection and diagnostic methods are described in detail below.

Additionally, antibodies are useful in pharmacogenomic analysis. Thus, antibodies prepared against polymorphic proteins can be used to identify individuals that require modified treatment modalities. The antibodies are also useful as diagnostic tools, as an immunological marker for aberrant protein analyzed by electrophoretic mobility, isoelectric point, tryptic peptide digest, and other physical assays known to those in the art.

The antibodies are also useful for tissue typing. Where a specific protein has been correlated with expression in a specific tissue, antibodies that are specific for this protein can be used to identify a tissue type.

The invention also encompasses kits for using antibodies to detect the presence of a protein in a biological sample. The kit can comprise antibodies such as a labeled or labelable antibody and a compound or agent for detecting protein in a biological sample; means for determining the amount of protein in the sample; means for comparing the amount of protein in the sample with a standard; and instructions for use. Such a kit can be supplied to detect a single protein or epitope or can be configured to detect one of a multitude of epitopes, such as in an antibody detection array. Arrays are described in detail below for nucleic acid arrays and similar methods have been developed for antibody arrays.

9. Methods of Treatment Based on CAT Proteins a. Antibody Therapy

The antibody of the present invention can be used for therapeutic reasons. It is contemplated that the antibody of the present invention may be used to treat a mammal, preferably a human with a disease.

In general, the antibodies are also useful for inhibiting protein function, for example, blocking the binding of a CAT protein or peptide to a binding partner such as a substrate. These uses can also be applied in a therapeutic context in which treatment involves inhibiting the protein's function. An antibody can be used, for example, to block binding, thus modulating (agonizing or antagonizing) the peptides activity. Antibodies can be prepared against specific fragments containing sites required for function or against intact protein that is associated within a cell or cell membrane. The functional blocking assays are provided in detail in the Examples.

The antibodies of present invention can also be used as means of enhancing the immune response. The antibodies can be administered in amounts similar to those used for other therapeutic administrations of antibody. For example, pooled gamma globulin is administered at a range of about 1 mg to about 100 mg per patient.

Antibodies reactive with CAT proteins or peptides can be administered alone or in conjunction with other therapies, such as anti-cancer therapies, to a mammal afflicted with cancer or other disease. Examples of anti-cancer therapies include, but are not limited to, chemotherapy, radiation therapy, and adoptive immunotherapy therapy with TIL (Tumor Infiltration Lymphocytes).

The selection of an antibody subclass for therapy will depend upon the nature of the antigen to be acted upon. For example, an IgM may be preferred in situations where the antigen is highly specific for the diseased target and rarely occurs on normal cells. However, where the disease-associated antigen is also expressed in normal tissues, although at much lower levels, the IgG subclass may be preferred, since the binding of at least two IgG molecules in close proximity is required to activate complement, less complement mediated damage may occur in the normal tissues which express smaller amounts of the antigen and, therefore, bind fewer IgG antibody molecules. Furthermore, IgG molecules by being smaller may be more able than IgM molecules to localize to the diseased tissue.

The mechanism for antibody therapy is that the therapeutic antibody recognizes a cell surface protein or a cytosolic protein that is expressed or preferably, overexpressed in a diseased cell. By NK cell or complement activation, or conjugation of the antibody with an immunotoxin or radiolabel, the interaction can abrogate ligand/receptor interaction or activation of apoptosis.

The potential mechanisms of antibody-mediated cytotoxicity of diseased cells are phagocyte (antibody dependent cellular cytotoxicity (ADCC)) (see Example), complement (Complement-mediated cytotoxicity (CMC)) (see Example), naked antibody (receptor cross-linking apoptosis and growth factor inhibition), or targeted payload labeled with radionuclide or immunotoxins or immunochemotherapeutics.

In one embodiment, the antibody is administered to a nonhuman mammal for the purposes of obtaining preclinical data, for example. Exemplary nonhuman mammals to be treated include nonhuman primates, dogs, cats, rodents and other mammals in which preclinical studies are performed. Such mammals may be established animal models for a disease to be treated with the antibody or may be used to study toxicity of the antibody of interest. In each of these embodiments, dose escalation studies may be performed on the mammal.

The antibody is administered by any suitable means, including parenteral, subcutaneous, intraperitoneal, intrapulmonary, and intranasal, and, if desired for local immunosuppressive treatment, intralesional administration. Parenteral infusions include intramuscular, intravenous, intraarterial, intraperitoneal, or subcutaneous administration. In addition, the antibody variant is suitably administered by pulse infusion, particularly with declining doses of the antibody variant. Preferably the dosing is given by injections, most preferably intravenous or subcutaneous injections, depending in part on whether the administration is brief or chronic.

For the prevention or treatment of a disease, the appropriate dosage of the antibody will depend on the type of disease to be treated, the severity and the course of the disease, whether the antibody is administered for preventive or therapeutic purposes, previous therapy, the patient's clinical history and response to the antibody, and the discretion of the attending physician.

Depending on the type and severity of the disease, about 1 μg/kg to 150 mg/kg (e.g., 0.1-20 mg/kg) of antibody is an initial candidate dosage for administration to the patient, whether, for example, by one or more separate administrations, or by continuous infusion. A typical daily dosage might range from about 1 μg/kg to 100 mg/kg or more, depending on the factors mentioned above. For repeated administrations over several days or longer, depending on the condition, the treatment is sustained until a desired suppression of disease symptoms occurs. However, other dosage regimens may be useful. The progress of this therapy is easily monitored by conventional techniques and assays.

The antibody composition will be formulated, dosed and administered in a manner consistent with good medical practice. Factors for consideration in this context include the particular disorder being treated, the particular mammal being treated, the clinical condition of the individual patient, the cause of the disorder, the site of delivery of the agent, the method of administration, the scheduling of administration, and other factors known to medical practitioners.

The therapeutically effective amount of the antibody to be administered will be governed by such considerations, and is the minimum amount necessary to prevent, ameliorate, or treat a disease or disorder. The antibody may optionally be formulated with one or more agents currently used to prevent or treat the disorder in question.

Suitable agents in this regard include radionuclides, differentiation inducers, drugs, toxins, and derivatives thereof. Preferred radionuclides include $^{90}$Y, $^{123}$I, $^{125}$I, $^{131}$I, $^{186}$Re, $^{188}$Re $^{211}$At, and $^{212}$Bi. Preferred drugs include methotrexate, and pyrimidine and purine analogs. Preferred differentiation inducers include phorbol esters and butyric acid. Preferred toxins include ricin, abrin, diptheria toxin, cholera toxin, gelonin, *Pseudomonas* exotoxin, *Shigella* toxin, and pokeweed antiviral protein A therapeutic agent may be coupled (e.g., covalently bonded) to a suitable antibody either directly or indirectly (e.g., via a linker group). A direct reaction between an agent and an antibody is possible when each possesses a substituent capable of reacting with the other. For example, a nucleophilic group, such as an amino or sulfhydryl group, on one may be capable of reacting with a carbonyl-containing group, such as an anhydride or an acid halide, or with an alkyl group containing a good leaving group (e.g., a halide) on the other.

Alternatively, it may be desirable to couple a therapeutic agent and an antibody via a linker group. A linker group can function as a spacer to distance an antibody from an agent in order to avoid interference with binding capabilities. A linker group can also serve to increase the chemical reactivity of a substituent on an agent or an antibody, and thus increase the coupling efficiency. An increase in chemical reactivity may also facilitate the use of agents, or functional groups on agents, which otherwise would not be possible.

It will be evident to those skilled in the art that a variety of bifunctional or polyfunctional reagents, both homo- and hetero-functional (such as those described in the catalog of the Pierce Chemical Co., Rockford, Ill.), may be employed as the linker group. Coupling may be affected, for example, through amino groups, carboxyl groups, sulfhydryl groups or oxidized carbohydrate residues. There are numerous references describing such methodology, e.g. U.S. Pat. No. 4,671,958, to Rodwell et al.

Where a therapeutic agent is more potent when free from the antibody portion of the immunoconjugates of the present invention, it may be desirable to use a linker group which is cleavable during or upon internalization into a cell. A number of different cleavable linker groups have been described. The mechanisms for the intracellular release of an agent from these linker groups include cleavage by reduction of a disulfide bond (e.g., U.S. Pat. No. 4,489,710, to Spitler), by irradiation of a photolabile bond (e.g., U.S. Pat. No. 4,625,014, to Senter et al.), by hydrolysis of derivatized amino acid side chains (e.g., U.S. Pat. No. 4,638,045, to Kohn et al.), by serum complement-mediated hydrolysis (e.g., U.S. Pat. No. 4,671,958, to Rodwell et al.), and acid-catalyzed hydrolysis (e.g., U.S. Pat. No. 4,569,789, to Blattler et al.).

It may be desirable to couple more than one agent to an antibody. In one embodiment, multiple molecules of an agent are coupled to one antibody molecule. In another embodiment, more than one type of agent may be coupled to one antibody. Regardless of the particular embodiment, immunoconjugates with more than one agent may be prepared in a variety of ways as described above.

b. Other Immunotherapy

Peptides derived from a CAT protein sequence may be modified to increase their immunogenicity by enhancing the binding of the peptide to the MHC molecules in which the peptide is presented. The peptide or modified peptide may be conjugated to a carrier molecule to enhance the antigenicity of the peptide. Examples of carrier molecules, include, but are not limited to, human albumin, bovine albumin, lipoprotein and keyhole limpet hemo-cyanin ("Basic and Clinical Immunology" (1991) Stites, D. P. and Terr A. I. (eds) Appleton and Lange, Norwalk Conn., San Mateo, Calif.).

An "immunogenic peptide" is a peptide, which comprises an allele-specific motif such that the peptide will bind the MHC allele (HLA in human) and be capable of inducing a CTL (cytotoxic T-lymphocytes) response. Thus, immunogenic peptides are capable of binding to an appropriate class I or II MHC molecule and inducing a cytotoxic T cell or T helper cell response against the antigen from which the immunogenic peptide is derived.

Alternatively, amino acid sequence variants of the peptide can be prepared by altering the nucleic acid sequence of the DNA which encodes the peptide, or by peptide synthesis. At the genetic level, these variants ordinarily are prepared by site-directed mutagenesis of nucleotides in the DNA encoding the peptide molecule, thereby producing DNA encoding the variant, and thereafter expressing the DNA in recombinant cell culture. The variants typically exhibit the same qualitative biological activity as the nonvariant peptide.

Recombinant or natural CAT proteins, peptides, fragment thereof, or modified peptides, may be used as a vaccine either prophylactically or therapeutically. When provided prophylactically the vaccine is provided in advance of any evidence of disease, particularly, cancer. The prophylactic administration of the disease vaccine should serve to prevent or attenuate diseases, preferably cancer, in a mammal.

Preparation of vaccine uses recombinant protein or peptide expression vectors comprising a nucleic acid sequence encoding all or part of a CAT protein. Examples of vectors that may be used in the aforementioned vaccines include, but are not limited to, defective retroviral vectors, adenoviral vectors vaccinia viral vectors, fowl pox viral vectors, or other viral vectors (Mulligan, R. C., (1993) Science 260:926-932). The vectors can be introduced into a mammal either prior to any evidence of the disease or to mediate regression of the disease in a mammal afflicted with disease. Examples of methods for administering the viral vector into the mammals include, but are not limited to, exposure of cells to the virus ex vivo, or injection of the retrovirus or a producer cell line of the virus into the affected tissue or intravenous administration of the virus. Alternatively the vector may be administered locally by direct injection into the cancer lesion or topical application in a pharmaceutically acceptable carrier. The quantity of viral vector, carrying all or part of a CAT nucleic acid sequence, to be administered is based on the titer of virus particles. A preferred range may be about $10^6$ to about $10^{11}$ virus particles per mammal, preferably a human.

After immunization the efficacy of the vaccine can be assessed by the production of antibodies or immune cells that recognize the antigen, as assessed by specific lytic activity or specific cytokine production or by tumor regression. One skilled in the art would know the conventional methods to assess the aforementioned parameters. If the mammal to be immunized is already afflicted with cancer, the vaccine can be administered in conjunction with other therapeutic treatments. Examples of other therapeutic treatments includes, but are not limited to, adoptive T cell immunotherapy, coadministration of cytokines or other therapeutic drugs for cancer.

Alternatively, all or parts thereof of a substantially or partially purified CAT protein or peptides may be administered as a vaccine in a pharmaceutically acceptable carrier. Ranges of the protein that may be administered are about 0.001 to about 100 mg per patient, preferred doses are about 0.01 to about 100 mg per patient. Immunization may be repeated as necessary, until a sufficient titer of anti-immunogen antibody or immune cells has been obtained.

In yet another alternative embodiment a viral vector, such as a retroviral vector, can be introduced into mammalian cells. Examples of mammalian cells into which the retroviral vector can be introduced include, but are not limited to, primary mammalian cultures or continuous mammalian cultures, COS cells, NIH3T3, or 293 cells (ATTC #CRL 1573), dendritic cells. The means by which the vector carrying the gene may be introduced into a cell includes, but is not limited to, microinjection, electroporation, transfection or transfection using DEAE dextran, lipofection, calcium phosphate or other procedures known to one skilled in the art (Sambrook et al. 3rd. ed., Cold Spring Harbor Laboratory Press, Cold Spring Harbor, N.Y., (2001).

The vaccine formulation of the present invention comprises an immunogen that induces an immune response directed against the cancer associated antigen such as a CAT protein, and in nonhuman primates and finally in humans. The safety of the immunization procedures is determined by looking for the effect of immunization on the general health of the immunized animal (weight change, fever, appetite behavior etc.) and looking for pathological changes on autopsies. After initial testing in animals, cancer patients can be tested. Conventional methods would be used to evaluate the immune response of the patient to determine the efficiency of the vaccine.

In one embodiment mammals, preferably human, at high risk for disease, particularly cancer, are prophylactically treated with the vaccines of this invention. Examples include, but are not limited to, humans with a family history of a disease, humans with a history of disease, particular cancer, or humans afflicted with a disease, such as cancer that has been previously resected and therefore at risk for reoccurrence. When provided therapeutically, the vaccine is provided to enhance the patient's own immune response to the disease antigen present on the disease cells or present during advanced stage of the disease. The vaccine, which acts as an immunogen, may be a cell, cell lysate from cells transfected with a recombinant expression vector, or a culture supernatant containing the expressed protein. Alternatively, the immunogen is a partially or substantially purified recombinant protein, peptide or analog thereof or modified peptides or analogs thereof. The proteins or peptides may be conjugated with lipoprotein or administered in liposomal form or with adjuvant.

While it is possible for the immunogen to be administered in a pure or substantially pure form, it is preferable to present it as a pharmaceutical composition, formulation or preparation, as discussed hereinabove.

Vaccination can be conducted by conventional methods. For example, the immunogen can be used in a suitable diluent such as saline or water, or complete or incomplete adjuvants. Further, the immunogen may or may not be bound to a carrier to make the protein immunogenic. Examples of such carrier molecules include but are not limited to bovine serum albumin (BSA), keyhole limpet hemocyanin (KLH), tetanus toxoid, and the like. The immunogen also may be coupled with lipoproteins or administered in liposomal form or with adjuvants. The immunogen can be administered by any route-appropriate for antibody production such as intravenous, intraperitoneal, intramuscular, subcutaneous, and the like. The immunogen may be administered once or at periodic intervals until a significant titer of anti-CAT immune cells or anti-CAT antibody is produced. The presence of anti-CAT immune cells may be assessed by measuring the frequency of precursor CTL (cytotoxic T-lymphocytes) against CAT antigen prior to and after immunization by a CTL precursor analysis assay (Coulie, P. et al., (1992) International Journal Of Cancer 50:289-297). The antibody may be detected in the serum using the immunoassay described above.

The safety of the immunization procedures is determined by examining the effect of immunization on the general health of the immunized animal (fever, change in weight, appetite, behavior etc.) and pathological changes on autopsies. After initial testing in animals, human patients can be tested. Conventional methods would be used to evaluate the immune response of the patient to determine the efficiency of the vaccine.

In yet another embodiment of this invention, all or portions of a CAT protein or peptides or fragments thereof, or modified peptides, may be exposed to dendritic cells cultured in vitro. The cultured dendritic cells provide a means of producing T-cell dependent antigens comprised of dendritic cell modified antigen or dendritic cells pulsed with antigen, in which the antigen is processed and expressed on the antigen activated dendritic cell. The CAT antigen activated dendritic cells or processed dendritic cell antigens may be used as immunogens for vaccines or for the treatment of diseases, particularly cancer. The dendritic cells should be exposed to the antigen for sufficient time to allow the antigens to be internalized and presented on the dendritic cells surface. The resulting dendritic cells or the dendritic-cell processed antigens can then be administered to an individual in need of therapy. Such methods are described in Steinman et al. (WO93/208185) and in Banchereau et al. (EPO Application 0563485A1).

In yet another aspect of this invention T-cells isolated from individuals can be exposed to CAT proteins, peptides or fragment thereof, or modified peptides in vitro and then administered to a patient in need of such treatment in a therapeutically effective amount. Examples of where T-lymphocytes can be isolated include but are not limited to, peripheral blood cells lymphocytes (PBL), lymph nodes, or tumor infiltrating lymphocytes (TIL). Such lymphocytes can be isolated from the individual to be treated or from a donor by methods known in the art and cultured in vitro (Kawakami, Y. et al. (1989) J. Immunol. 142: 2453-3461). Lymphocytes are cultured in media such as RPMI or RPMI 1640 or AIM V for 1-10 weeks. Viability is assessed by trypan blue dye exclusion assay. Examples of how these sensitized T-cells can be administered to the mammal include but are not limited to, intravenously, intraperitoneally or intralesionally. Parameters that may be assessed to determine the efficacy of these sensitized T-lymphocytes include, but are not limited to, production of immune cells in the mammal being treated or tumor regression. Conventional methods are used to assess these parameters. Such treatment can be given in conjunction with cytokines or gene modified cells (Rosenberg, S. A. et al. (1992) Human Gene Therapy, 3: 75-90; Rosenberg, S. A. et al. (1992) Human Gene Therapy, 3: 57-73).

The present invention is further described by the following examples, which are provided solely to illustrate the invention by reference to specific embodiments. This exemplification, while illustrating certain aspects of the invention, does not offer the limitations or circumscribe the scope of the disclosed invention.

10. Screening Methods Using Proteins

CAT proteins can be used to identify compounds or agents that modulate activity of a CAT protein in its natural state or an altered form that causes a specific disease or pathology associated with CAT. CAT of the present invention, as well as appropriate variants and fragments, can be used in high-throughput screens to assay candidate compounds for the ability to bind to CAT. These compounds can be further screened against functional CAT to determine the effect of the compound on CAT activity. Further, these compounds can be tested in animal or invertebrate systems to determine activity/effectiveness. Compounds can be identified that activate (agonist) or inactivate (antagonist) CAT to a desired degree.

CAT of the present invention, as well as appropriate variants and fragments, can be used in high-throughput screening to assay candidate compounds for the ability to bind to CAT. These compounds can be further screened against functional CAT to determine the effect of the compound on CAT activity. Further, these compounds can be tested in animal or invertebrate systems to determine activity/effectiveness. Compounds can be identified that activate (agonist) or inactivate (antagonist) CAT to a desired degree.

Further, the proteins of the present invention can be used to screen a compound or an agent for the ability to stimulate or inhibit interaction between a CAT protein and a molecule that normally interacts with the CAT protein, e.g. a substrate or an extracellular binding ligand or a component of the signal pathway that the CAT protein normally interacts (for example, a cytosolic signal protein). Such assays typically include the steps of combining a CAT protein with a candidate compound under conditions that allow the CAT protein, or fragment, to interact with the target molecule, and to detect the formation of a complex between the protein and the target or to detect the biochemical consequence of the interaction with the CAT protein and the target, such as any of the associated effects of signal transduction such as protein phosphorylation, cAMP turnover, and adenylate cyclase activation, etc.

Candidate compounds or agents include 1) peptides such as soluble peptides, including Ig-tailed fusion peptides and members of random peptide libraries (see, e.g., Lam et al., Nature 354:82-84 (1991); Houghten et al., Nature 354:84-86 (1991)) and combinatorial chemistry-derived molecular libraries made of D- and/or L-configuration amino acids; 2) phosphopeptides (e.g., members of random and partially degenerate, directed phosphopeptide libraries, see, e.g., Songyang et al., Cell 72:767-778 (1993)); 3) antibodies (e.g., polyclonal, monoclonal, humanized, anti-idiotypic, chimeric, and single chain antibodies as well as Fab, F(ab')2, Fab expression library fragments, and epitope-binding fragments of antibodies); and 4) small organic and inorganic molecules (e.g., molecules obtained from combinatorial and natural product libraries).

One candidate compound or agent is a soluble fragment of a CAT that competes for substrate binding. Other candidate compounds include mutant CAT or appropriate fragments containing mutations that affect CAT function and thus compete for substrate. Accordingly, a fragment that competes for substrate, for example with a higher affinity, or a fragment that binds substrate but does not allow release, is encompassed by the invention.

Any of the biological or biochemical functions mediated by a CAT can be used as an endpoint assay to identify an agent that modulates CAT activity. These include all of the biochemical or biochemical/biological events described herein, in the references cited herein, incorporated by reference for these endpoint assay targets, and other functions known to those of ordinary skill in the art or that can be readily identified. Specifically, a biological function of a cell or tissues that expresses CAT can be assayed.

A substrate-binding region can be used that interacts with a different substrate than one which is recognized by a native CAT. Accordingly, a different set of signal transduction components is available as an end-point assay for activation. This allows for assays to be performed in other than the specific host cell from which a CAT is derived.

Competition binding assays may also be used to discover compounds that interact with a CAT (e.g. binding partners and/or ligands). Thus, a compound can be exposed to a CAT polypeptide under conditions that allow the compound to bind or to otherwise interact with the polypeptide. Soluble CAT polypeptide is also added to the mixture. If the test compound interacts with the soluble CAT polypeptide, it decreases the amount of complex formed or activity from CAT. This type of assay is particularly useful in cases in which compounds are sought that interact with specific regions of CAT. Thus, the soluble polypeptide that competes with the target CAT region is designed to contain peptide sequences corresponding to the region of interest.

To perform cell free drug screening assays, it is sometimes desirable to immobilize either the CAT protein, or fragment, or its target molecule to facilitate separation of complexes from uncomplexed forms of one or both of the proteins, as well as to accommodate automation of the assay.

Techniques for immobilizing proteins on matrices can be used in the drug screening assays. In one embodiment, a fusion protein can be provided which adds a domain that allows the protein to be bound to a matrix. For example, glutathione-S-transferase fusion proteins can be adsorbed onto glutathione SEPHAROSE beads (Sigma Chemical, St.

Louis, Mo.) or glutathione derivatized microtitre plates, which are then combined with the cell lysates (e.g., $^{35}$S-labeled) and the candidate compound, and the mixture incubated under conditions conducive to complex formation (e.g., at physiological conditions for salt and pH). Following incubation, the beads are washed to remove any unbound label, and the matrix immobilized and radiolabel determined directly, or in the supernatant after the complexes are dissociated. Alternatively, the complexes can be dissociated from the matrix, separated by SDS-PAGE, and the level of CAT-binding protein found in the bead fraction quantitated from the gel using standard electrophoretic techniques. For example, either the polypeptide or its target molecule can be immobilized utilizing conjugation of biotin and streptavidin using techniques well known in the art. Alternatively, antibodies reactive with the protein but which do not interfere with binding of the protein to its target molecule can be derivatized to the wells of the plate, and the protein trapped in the wells by antibody conjugation. Preparations of CAT-binding protein and a candidate compound are incubated in CAT protein-presenting wells and the amount of complex trapped in the well can be quantitated. Methods for detecting such complexes, in addition to those described above for the GST-immobilized complexes, include immunodetection of complexes using antibodies reactive with a CAT protein target molecule, or which are reactive with CAT protein and compete with the target molecule, as well as CAT-linked assays which rely on detecting an enzymatic activity associated with the target molecule.

Agents that modulate a CAT of the present invention can be identified using one or more of the above assays, alone or in combination. It is generally preferable to use a cell-based or cell free system first and then confirm activity in an animal or other model system. Such model systems are well known in the art and can readily be employed in this context.

In yet another aspect of the invention, a CAT protein can be used as a "bait protein" in a two-hybrid assay or three-hybrid assay (see, e.g., U.S. Pat. No. 5,283,317; Zervos et al. (1993) Cell 72:223-232; Madura et al. (1993) J. Biol. Chem. 268: 12046-12054; Bartel et al. (1993) Biotechniques 14:920-924; Iwabuchi et al. (1993) Oncogene 8:1693-1696; and Brent WO94/10300), to identify other proteins, which bind to or interact with CAT and are involved in CAT activity. Such CAT-binding proteins are also likely to be involved in the propagation of signals by a CAT protein or CAT targets as, for example, downstream elements of a CAT-mediated signaling pathway. Alternatively, such CAT-binding proteins are likely to be CAT inhibitors.

The two-hybrid system is based on the modular nature of most transcription factors, which consist of separable DNA-binding and activation domains. Briefly, the assay utilizes two different DNA constructs. In one construct, the gene that codes for a CAT protein is fused to a gene encoding the DNA binding domain of a known transcription factor (e.g., GAL-4). In the other construct, a DNA sequence, from a library of DNA sequences that encode an unidentified protein ("prey" or "sample") is fused to a gene that codes for the activation domain of the known transcription factor. If the "bait" and the "prey" proteins are able to interact, in vivo, forming a CAT-dependent complex, the DNA-binding and activation domains of the transcription factor are brought into close proximity. This proximity allows transcription of a reporter gene (e.g., LacZ) which is operably linked to a transcriptional regulatory site responsive to the transcription factor. Expression of the reporter gene can be detected and cell colonies containing the functional transcription factor can be isolated and used to obtain the cloned gene which encodes the protein which interacts with the CAT protein.

Array:

"Array" refers to an ordered arrangement of at least two transcripts, proteins or peptides, or antibodies on a substrate. At least one of the transcripts, proteins, or antibodies represents a control or standard, and the other transcript, protein, or antibody is of diagnostic or therapeutic interest. The arrangement of at least two and up to about 40,000 transcripts, proteins, or antibodies on the substrate assures that the size and signal intensity of each labeled complex, formed between each transcript and at least one nucleic acid, each protein and at least one ligand or antibody, or each antibody and at least one protein to which the antibody specifically binds, is individually distinguishable.

An "expression profile" is a representation of gene expression in a sample. A nucleic acid expression profile is produced using sequencing, hybridization, or amplification technologies using transcripts from a sample. A protein expression profile, although time delayed, mirrors the nucleic acid expression profile and is produced using gel electrophoresis, mass spectrometry, or an array and labeling moieties or antibodies which specifically bind the protein. The nucleic acids, proteins, or antibodies specifically binding the protein may be used in solution or attached to a substrate, and their detection is based on methods well known in the art.

A substrate includes but is not limited to, paper, nylon or other type of membrane, filter, chip, glass slide, or any other suitable solid support.

The present invention also provides an antibody array. Antibody arrays have allowed the development of techniques for high-throughput screening of recombinant antibodies. Such methods use robots to pick and grid bacteria containing antibody genes, and a filter-based ELISA to screen and identify clones that express antibody fragments. Because liquid handling is eliminated and the clones are arrayed from master stocks, the same antibodies can be spotted multiple times and screened against multiple antigens simultaneously. For more information, see de Wildt et al. (2000) Nat. Biotechnol. 18:989-94.

The array is prepared and used according to the methods described in U.S. Pat. No. 5,837,832, Chee et al., PCT application WO95/11995 (Chee et al.), Lockhart, D. J. et al. (1996; Nat. Biotech. 14: 1675-1680) and Schena, M. et al. (1996; Proc. Natl. Acad. Sci. 93: 10614-10619), U.S. Pat. No. 5,807,522, Brown et al., all of which are incorporated herein in their entirety by reference.

In one embodiment, a nucleic acid array or a microarray, preferably composed of a large number of unique, single-stranded nucleic acid sequences, usually either synthetic antisense oligonucleotides or fragments of cDNAs, fixed to a solid support. The oligonucleotides are preferably about 6-60 nucleotides in length, more preferably 15-30 nucleotides in length, and most preferably about 20-25 nucleotides in length.

In order to produce oligonucleotides to a known sequence for an array, the gene(s) of interest (or an ORF identified from the contigs of the present invention) is typically examined using a computer algorithm which starts at the 5' or at the 3' end of the nucleotide sequence. Typical algorithms will then identify oligomers of defined length that are unique to the gene, have a GC content within a range suitable for hybridization, and lack predicted secondary structure that may interfere with hybridization. In certain situations it may be appropriate to use pairs of oligonucleotides on an array. The "pairs" will be identical, except for one nucleotide that preferably is located in the center of the sequence. The second oligonucleotide in the pair (mismatched by one) serves as a control. The number of oligonucleotide pairs may range from two to one million. The oligomers are synthesized at designated areas on a substrate using a light-directed chemical process, wherein the substrate may be paper, nylon or other type of membrane, filter, chip, glass slide or any other suitable solid support as described above.

In another aspect, an oligonucleotide may be synthesized on the surface of the substrate by using a chemical coupling procedure and an ink jet application apparatus, as described in PCT application WO95/251116 (Baldeschweiler et al.) which is incorporated herein in its entirety by reference.

A gene expression profile comprises the expression of a plurality of transcripts as measured by after hybridization with a sample. The transcripts of the invention may be used as elements on an array to produce a gene expression profile. In one embodiment, the array is used to diagnose or monitor the progression of disease. Researchers can assess and catalog the differences in gene expression between healthy and diseased tissues or cells.

For example, the transcript or probe may be labeled by standard methods and added to a biological sample from a patient under conditions for the formation of hybridization complexes. After an incubation period, the sample is washed and the amount of label (or signal) associated with hybridization complexes, is quantified and compared with a standard value. If complex formation in the patient sample is significantly altered (higher or lower) in comparison to either a normal or disease standard, then differential expression indicates the presence of a disorder.

In order to provide standards for establishing differential expression, normal and disease expression profiles are established. This is accomplished by combining a sample taken from normal subjects, either animal or human or nonmammal, with a transcript under conditions for hybridization to occur. Standard hybridization complexes may be quantified by comparing the values obtained using normal subjects with values from an experiment in which a known amount of a purified sequence is used. Standard values obtained in this manner may be compared with values obtained from samples from patients who were diagnosed with a particular condition, disease, or disorder. Deviation from standard values toward those associated with a particular disorder is used to diagnose that disorder.

By analyzing changes in patterns of gene expression, disease can be diagnosed at earlier stages before the patient is symptomatic. The invention can be used to formulate a prognosis and to design a treatment regimen. The invention can also be used to monitor the efficacy of treatment. For treatments with known side effects, the array is employed to improve the treatment regimen. A dosage is established that causes a change in genetic expression patterns indicative of successful treatment. Expression patterns associated with the onset of undesirable side effects are avoided.

In another embodiment, animal models which mimic a human disease can be used to characterize expression profiles associated with a particular condition, disease, or disorder; or treatment of the condition, disease, or disorder. Novel treatment regimens may be tested in these animal models using arrays to establish and then follow expression profiles over time. In addition, arrays may be used with cell cultures or tissues removed from animal models to rapidly screen large numbers of candidate drug molecules, looking for ones that produce an expression profile similar to those of known therapeutic drugs, with the expectation that molecules with the same expression profile will likely have similar therapeutic effects. Thus, the invention provides the means to rapidly determine the molecular mode of action of a drug.

Such assays may also be used to evaluate the efficacy of a particular therapeutic treatment regimen in animal studies or in clinical trials or to monitor the treatment of an individual patient. Once the presence of a condition is established and a treatment protocol is initiated, diagnostic assays may be repeated on a regular basis to determine if the level of expression in the patient begins to approximate that which is observed in a normal subject. The results obtained from successive assays may be used to show the efficacy of treatment over a period ranging from several days to years.

WORKING EXAMPLES

1. Tissue Processing and Cell Lines

Tissue Processing:

All tissues were procured as fresh specimens. Tissues were collected as remnant tissues following surgical resection of cancer tissues. Remnant tissues were supplied following processing for pathological diagnosis according to proper standards of patient care. Procurement of all tissues was performed in an anonymised manner in strict compliance with Federal mandated ethical and legal guidelines (HIPAA) and in accordance with clinical institution ethical review board as well as the internal institutional review board. Tissues were transported on ice in ice-cold transport buffer by courier for processing.

i) Enrichment of Epithelial Cells from Normal Tissue:

Normal tissue was transferred from the transport vessel to a sterile dish containing 25 ml of ice-cold transport buffer. The tissue was measured, weighed and photographed. The tissue was dissected to isolate tissue for transfer to a fresh dish containing 25 ml ice-cold Hanks buffered saline solution. The tissue section was washed by vigorous shaking and the HBSS replaced. This was repeated two further times or until all visible mucus was removed. Mucosa was measured, weighed and diced into 1 mm2 sections. The tissues sections were transferred to a 50 ml polypropylene centrifuge tube containing 50 ml of A52 media (Biosource) supplemented with 2 mM L-glutamine and 1.5 mg/ml dispase (Roche Biochemicals). The digest was incubated for 1 h at 37° C. with frequent agitation. Following the incubation, the suspension was poured through a 40-mesh cell sieve situated in the base of a 15 cm culture dish. The filtrate was diluted to 50 ml using A52 media supplemented with 2 mM L-glutamine and passed through a 200-mesh cell sieve. The filtrate was collected into a 50 ml polypropylene centrifuge tube and the suspension was triturated several times followed by vortexing for 2 min at setting 6. The density and viability of nucleated cells was determined by flow cytometry using propidium iodide as a negative stain for viability (Guava system). Erythrocytes were lysed using a standard ammonium chloride lysis protocol with incubation at room temperature for 10 s. Cells were harvested by centrifugation at 500 g for 5 min at 4° C. The cell pellet was resuspended in 50 ml of ice-cold HBSS and recentrifuged. The final cell pellet was resuspended in 3 ml of ice-cold HBSS supplemented with 0.1% BSA and 0.25M EDTA. Cell density and viability were estimated using the Guava system and the density adjusted to $1\times10^7$ cells per ml. Epithelial cells were stained with a FITC-labeled anti-EpCAM murine monoclonal antibody and enriched by cell sorting using flow cytometry.

ii) Enrichment of Tumor Cells from Cancer Tissue

Cancer tissue was transferred from the transport vessel to a sterile dish containing 25 ml of ice-cold transport buffer. The tissue was measured, weighed and photographed. The tissue was dissected to remove necrotic and fibrotic tissue plaques and the tumour tissue transferred to a fresh dish containing 25 ml ice-cold Hanks buffered saline solution. The tissue section was washed by vigorous shaking and the HBSS replaced. This was repeated 2 further times or until all visible mucus was removed. Tumor tissue was measured, weighed and extensively diced. The tissues slurry was transferred to a 50 ml polypropylene centrifuge tube containing 50 ml of A52 media (Biosource) supplemented with 2 mM L-glutamine and 1.5 mg/ml dispase (Roche Biochemicals). The digest was incubated for 1 h at 37° C. with frequent agitation. Following the incubation, the suspension was poured through a 40-mesh cell sieve situated in the base of a 15 cm culture dish. The filtrate was diluted to 50 ml using A52 media supplemented with 2 mM L-glutamine and passed through a 200-mesh cell sieve. The filtrate was collected into a 50 ml polypropylene centrifuge tube and the suspension was triturated several times followed by vortexing for 2 min at setting 6. The density and viability of nucleated cells was determined by flow cytometry using propidium iodide as a negative stain for viability (Guava system). Erythrocytes were lysed using a standard ammonium chloride lysis protocol with incubation at room temperature for 10 s. Cells were harvested by centrifugation at 500 g for 5 min at 4° C. The cell pellet was resuspended in 50 ml of ice-cold HBSS and recentrifuged. The final cell pellet was resuspended in 3 ml of ice-cold HBSS supplemented with 0.1% BSA and 0.25M EDTA. Cell density and viability were estimated using the Guava system and the density adjusted to $1\times10^7$ cells per ml. Epithelial cells were stained with a FITC-labeled anti-EpCAM murine monoclonal antibody and enriched by cell sorting using flow cytometry.

iii) Enrichment of Cell Surface Proteins from Sorted Epithelial and Tumor Cells

Sorted cells were centrifuged at 500 g at 4° C. for 5 min and resuspended in 50 ml of ice-cold DPBS. The cell suspension was washed by 2 further cycles of centrifugation 500 g at 4° C. for 5 min and resuspension of the cell pellet in 50 ml of ice-cold DPBS. Finally, the cell pellet was resuspended in 9.5 ml of ice-cold DPBS and sodium metaperiodate added to a final concentration of 1 mM. The cell suspension was incubated on ice for 10 min with frequent agitation in the dark. Cells were centrifuged at 500 g at 4° C. for 5 min and resuspended in 50 ml of ice-cold DPBS. The cell suspension was washed by 2 further cycles of centrifugation 500 g at 4° C. for 5 min and resuspension of the cell pellet in 50 ml of ice-cold DPBS. Finally, the cell pellet was resuspended in lysis buffer (1% SDS [w/v]; 0.1M HEPES; 10 mM $MgCl_2$; 0.1% Non ionic detergent P40; 10 µl/ml protease inhibitor cocktail [P8340, Sigma]) and homogenisation performed by passage of lysate through a 18 G syringe needle 10 times. Protein concentrations were assayed relative to a Bovine serum albumin standard by a modified Lowry assay (DC assay, Bio-RAD) and 1 mg of total cellular protein transferred to a fresh tube and diluted to 1 mg/ml in acetate buffer (0.1M, pH 5.0).

Cancer Cell Lines:

The model system employed here involves the use of a "normal" reference (i.e., control) to which cell surface expression in tumor-derived cell lines is compared. These differentials or candidates are then validated in normal tissues and cancer tissues to confirm that they are differentially expressed between these tissues as well as within the cell line model system.

Cancer Cell Line Culture

Cell lines were grown in a culturing medium that is supplemented as necessary with growth factors and serum, in accordance with the American Type Culture Collection (ATCC) (Mannassas, Va.) guidelines for each particular cell line. Cultures were established from frozen stocks in which the cells were suspended in a freezing medium (cell culture medium with 10% DMSO [v/v]) and flash frozen in liquid nitrogen. Frozen stocks prepared in this way were stored in the liquid nitrogen vapour. Cell cultures were established by rapidly thawing frozen stocks at 37° C. Thawed stock cultures were slowly transferred to a culture vessel containing a large volume of culture medium that was supplemented. For maintenance of culture, cells were seeded at $1\times10^5$ cells/per ml in medium and incubated at 37° C. until confluence of cells in the culture vessel exceeds 50% by area. At this time, cells were harvested from the culture vessel using enzymes or EDTA where necessary. The density of harvested, viable cells was estimated by hemocytometry and the culture reseeded as above. A passage of this nature was repeated no more than 25 times at which point the culture was destroyed and reestablished from frozen stocks as described above.

For the analyses of cell surface protein expression in cultured cell lines, cells were grown as described above. At a period 24 h prior to the experiment, the cell line was passaged as described above. This yielded cell densities that were <50% confluent and growing exponentially. Typically, triplicate analyses of differential expression were performed for each line relative to Caco2 for the purpose of identifying statistically significant reproducible differentially expressed proteins.

2. Cloning and Expression of Target Proteins cDNA Retrieval

Peptide sequences were searched by BlastP against the Celera Discovery System (CDS) and public database to identify the corresponding full-length open reading frames (ORFs). Each ORF sequence was then searched by BlastN against the Celera in-house human cDNA clone collection. For each sequence of interest, up to three clones are pulled and streaked onto LB/Ampicillin (100 ug/ml) plates. Plasmid DNA is isolated using Qiagen spin mini-prep kit and verified by restriction digest. Subsequently, the isolated plasmid DNA is sequence verified against the ORF reference sequence. Sequencing reactions are carried out using Applied Biosystems BigDye Terminator kit followed by ethanol precipitation. Sequence data is collected using the Applied Biosystems 3100 Genetic Analyzer and analyzed by alignment to the reference sequence using the Clone Manager alignment tool.

PCR

PCR primers are designed to amplify the full-length ORF as well as any regions of the ORF that are interest for expression (antigenic or hydrophilic regions as determined by the Clone Manager sequence analysis tool). Primers also contain 5' and 3' overhangs to facilitate cloning (see below). PCR reactions contain 2.5 units Platinum Taq DNA Polymerase High Fidelity (Invitrogen), 50 ng cDNA plasmid template, 1 uM forward and reverse primers, 800 uM dNTP cocktail (Applied Biosystems) and 2 mM MgSO4. After 20-30 cycles (94° C. for 30 seconds, 55° C. for 1 minutes and 73° C. for 2 minutes), product is verified and quantitated by agarose gel electrophoresis.

Construction of Entry Clones

PCR products are cloned into an entry vector for use with the Gateway recombination based cloning system (Invitrogen). These vectors include pDonr221, pDonr201, pEntr/D-TOPO or pEntr/SD/D-TOPO and are used as described in the cloning methods below.

TOPO Cloning into pEntr/D-TOPO or pEntr/SD/D-TOPO

For cloning using this method, the forward PCR primer contained a 5' overhang containing the sequence "CACC". PCR products are generated as described above and cloned into the entry vector using the Invitrogen TOPO cloning kit. Reactions are typically carried out at room temperature for 10 minutes and subsequently transformed into TOP10 chemically competent cells (Invitrogen, CA). Candidate clones are picked, plasmid DNA is prepared using Qiagen spin mini-prep kit and screened using restriction digest. Inserts are subsequently sequence verified as described above.

Gateway Cloning into pDonr201 or pDonr221

For cloning using this method, PCR primers contained the following overhangs:

Forward 5' overhang:

5'-GGGGACAAGTTTGTACAAAAAAGCAGGCTTC-3' (SEQ ID NO:186)

Reverse 5' overhang:

5'-GGGGACCACTTTGTACAAGAAAGCTGGGT-3' (SEQ ID NO:187)

PCR products are generated as described above. ORFs are recombined into the entry vector using the Invitrogen Gateway BP Clonase enzyme mix. Reactions are typically carried out at 25° C. for 1 hour, treated with Proteinase K at 37° C. for 10 minutes and transformed into Library Efficiency DH5α chemically competent cells (Invitrogen, CA). Candidate clones are picked, plasmid DNA is prepared using Qiagen spin mini-prep kit and screened using restriction digest. Inserts are subsequently sequence verified as described above.

Construction of Expression Clones

ORFs are transferred from the entry construct into a series of expression vectors using the Gateway LR Clonase enzyme mix. Reactions are typically carried out for 1 hour at 25° C., treated with Proteinase K at 37° C. for 10 minutes and subsequently transformed into Library Efficiency DH5a chemically competent cells (Invitrogen). Candidate clones are picked, plasmid DNA is prepared using Qiagen spin mini-prep kit and screened using restriction digest. Expression vectors include but are not limited to pDest14, pDest15, pDest17, pDest8, pDest10 and pDest20. These vectors allow expression in systems such as *E. coli* and recombinant baculovirus. Other vectors not listed here allow expression in yeast, mammalian cells, or in vitro.

Expression of Recombinant Proteins in *E. coli*

Constructs are transformed into one or more of the following host strains: BL21 SI, BL21 AI, (Invitrogen); Origami B (DE3), Origami B (DE3) pLysS, Rosetta (DE3), Rosetta (DE3) pLysS, Rosetta-Gami (DE3), Rosetta-Gami (DE3) pLysS, or Rosetta-Gami B (DE3) pLysS (Novagen). The transformants are grown in LB with or without NaCl and with appropriate antibiotics, at temperatures in the range of 20-37° C., with aeration. Expression is induced with the addition of IPTG (0.03-0.3 mM) or NaCl (75-300 mM) when the cells are in mid-log growth. Growth is continued for one to 24 hours post-induction. Cells are harvested by centrifugation in a Sorvall RC-3C centrifuge in a H6000A rotor for 10 minutes at 3000 rpm, at 4° C. Cell pellets are stored at −80° C.

Expression of Recombinant Proteins Using Baculovirus

Recombinant proteins are expressed using baculovirus in Sf21 fall army worm ovarian cells. Recombinant baculoviruses are prepared using the Bac-to-Bac system (Invitrogen) per the manufacturer's instructions. Proteins are expressed on the large scale in Sf900II serum-free medium (Invitrogen) in a 10 L bioreactor tank (27° C., 130 rpm, 50% dissolved oxygen for 48 hours).

3. Recombinant Protein Purification

Recombinant proteins are purified from *E. coli* and/or insect cells using a variety of standard chromatography methods. Briefly, cells are lysed using sonication or detergents. The insoluble material is pelleted by centrifugation at 10,000×g for 15 minutes. The supernatant is applied to an appropriate affinity column, e.g. His-tagged proteins are separated using a pre-packed chelating sepharose column (Pharmacia) or GST-tagged proteins are separated using a glutathione sepharose column (Pharmacia). After using the affinity column, proteins are further separated using various techniques, such as ion exchange chromatography (columns from Pharmacia) to separate on the basis of electrical charge or size exclusion chromatography (columns from Tosohaas) to separate on the basis of molecular weight, size and shape.

Expression and purification of the protein are also achieved using either a mammalian cell expression system or an insect cell expression system. The pUB6/V5-His vector system (Invitrogen, CA) is used to express GSCC in CHO cells. The vector contains the selectable bsd gene, multiple cloning sites, the promoter/enhancer sequence from the human ubiquitin C gene, a C-terminal V5 epitope for antibody detection with anti-V5 antibodies, and a C-terminal polyhistidine (6.times.His) sequence for rapid purification on PROBOND resin (Invitrogen, CA). Transformed cells are selected on media containing blasticidin.

*Spodoptera frugiperda* (Sf9) insect cells are infected with recombinant *Autographica californica* nuclear polyhedrosis virus (baculovirus). The polyhedrin gene is replaced with the cDNA by homologous recombination and the polyhedrin promoter drives-cDNA transcription. The protein is synthesized as a fusion protein with 6×his which enables purification as described above. Purified protein is used in the following activity and to make antibodies 4. Chemical Synthesis of Peptides Proteins or portions thereof may be produced not only by recombinant methods, but also by using chemical methods well known in the art. Solid phase peptide synthesis may be carried out in a batchwise or continuous flow process which sequentially adds α-amino- and side chain-protected amino acid residues to an insoluble polymeric support via a linker group. A linker group such as methylamine-derivatized polyethylene glycol is attached to poly(styrene-co-divinylbenzene) to form the support resin. The amino acid residues are N-a-protected by acid labile Boc (t-butyloxycarbonyl) or base-labile Fmoc (9-fluorenylmethoxycarbonyl). The carboxyl group of the protected amino acid is coupled to the amine of the linker group to anchor the residue to the solid phase support resin. Trifluoroacetic acid or piperidine are used to remove the protecting group in the case of Boc or Fmoc, respectively. Each additional amino acid is added to the anchored residue using a coupling agent or pre-activated amino acid derivative, and the resin is washed. The full length peptide is synthesized by sequential deprotection, coupling of derivitized amino acids, and washing with dichloromethane and/or N,N-dimethylformamide. The peptide is cleaved between the peptide carboxy terminus and the linker group to yield a peptide acid or amide. (Novabiochem 1997/98 Catalog and Peptide Synthesis Handbook, San Diego Calif. pp. S1-S20). Automated synthesis may also be carried out on machines such as the 431A peptide synthesizer (ABI). A protein or portion thereof may be purified by preparative high performance liquid chromatography and its composition confirmed by amino acid analysis or by sequencing (Creighton (1984) Proteins, Structures and Molecular Properties, W H Freeman, New York N.Y.).

5. Antibody Development

Polyclonal Antibody Preparations:

Polyclonal antibodies against recombinant proteins are raised in rabbits (Green Mountain Antibodies, Burlington, Vt.). Briefly, two New Zealand rabbits are immunized with 0.1 mg of antigen in complete Freund's adjuvant. Subsequent immunizations are carried out using 0.05 mg of antigen in incomplete Freund's adjuvant at days 14, 21 and 49. Bleeds are collected and screened for recognition of the antigen by solid phase ELISA and western blot analysis. The IgG fraction is separated by centrifugation at 20,000×g for 20 minutes followed by a 50% ammonium sulfate cut. The pelleted protein is resuspended in 5 mM Tris and separated by ion exchange chromatography. Fractions are pooled based on IgG content. Antigen-specific antibody is affinity purified using Pierce AminoLink resin coupled to the appropriate antigen.

Isolation of Antibody Fragments Directed Against CAT from a Library of scFvs

Naturally occurring V-genes isolated from human PBLs are constructed into a library of antibody fragments which contain reactivities against a CAT to which the donor may or may not have been exposed (see e.g., U.S. Pat. No. 5,885,793 incorporated herein by reference in its entirety).

Rescue of the Library: A library of scFvs is constructed from the RNA of human PBLs as described in PCT publication WO 92/01047. To rescue phage displaying antibody fragments, approximately $10^9$ *E. coli* harboring the phagemid are used to inoculate 50 ml of 2×TY containing 1% glucose and 100 mu.g/ml of ampicillin (2.times.TY-AMP-GLU) and grown to an O.D. of 0.8 with shaking. Five ml of this culture is used to innoculate 50 ml of 2.times.TY-AMP-GLU, $2\times10^8$ TU of delta gene 3 helper (M13 delta gene III, see PCT publication WO 92/01047) are added and the culture incubated at 37° C. for 45 minutes without shaking and then at 37° C. for 45 minutes with shaking. The culture is centrifuged at 4000 r.p.m. for 10 min. and the pellet resuspended in 2 liters of 2×TY containing 100 .mu.g/ml ampicillin and 50 ug/ml kanamycin and grown overnight. Phage are prepared as described in PCT publication WO 92/01047.

M13 delta gene III is prepared as follows: M13 delta gene III helper phage does not encode gene III protein, hence the phage(mid) displaying antibody fragments have a greater avidity of binding to antigen. Infectious M13 delta gene III particles are made by growing the helper phage in cells harboring a pUC19 derivative supplying the wild type gene III protein during phage morphogenesis. The culture is incubated for 1 hour at 37° C. without shaking and then for a further hour at 37° C. with shaking. Cells are spun down (IEC-Centra 8,400 r.p.m. for 10 min), resuspended in 300 ml 2×TY broth containing 100 .mu.g ampicillin/ml and 25 .mu.g kanamycin/ml (2×TY-AMP-KAN) and grown overnight, shaking at 37° C. Phage particles are purified and concentrated from the culture medium by two PEG-precipitations (Sambrook et al., 2001), resuspended in 2 ml PBS and passed through a 0.45 .mu.m filter (Minisart NML; Sartorius) to give a final concentration of approximately 1013 transducing units/ml (ampicillin-resistant clones).

Panning of the Library: Immunotubes (Nunc) are coated overnight in PBS with 4 ml of either 100 .mu.g/ml or 10 .mu.g/ml of a polypeptide of the present invention. Tubes are blocked with 2% Marvel-PBS for 2 hours at 37° C. and then washed 3 times in PBS. Approximately 1013 TU of phage is applied to the tube and incubated for 30 minutes at room temperature tumbling on an over and under turntable and then left to stand for another 1.5 hours. Tubes are washed 10 times with PBS 0.1% Tween-20 and 10 times with PBS. Phage are eluted by adding 1 ml of 100 mM triethylamine and rotating 15 minutes on an under and over turntable after which the solution is immediately neutralized with 0.5 ml of 1.0M Tris-HCl, pH 7.4. Phages are then used to infect 10 ml of mid-log *E. coli* TG1 by incubating eluted phage with bacteria for 30 minutes at 37° C. The *E. coli* are then plated on TYE plates containing 1% glucose and 100 .mu.g/ml ampicillin. The resulting bacterial library is then rescued with delta gene 3 helper phage as described above to prepare phage for a subsequent round of selection. This process is then repeated for a total of 4 rounds of affinity purification with tube-washing increased to 20 times with PBS, 0.1% Tween-20 and 20 times with PBS for rounds 3 and 4.

Characterization of Binders: Eluted phage from the 3rd and 4th rounds of selection are used to infect *E. coli* HB 2151 and soluble scFv is produced (Marks, et al., 1991) from single colonies for assay. ELISAs are performed with microtitre plates coated with either 10 .mu.g/ml of the polypeptide of the present invention in 50 mM bicarbonate pH 9.6. Clones positive in ELISA are further characterized by PCR fingerprinting (see, e.g., PCT publication WO 92/01047) and then by sequencing.

Monoclonal Antibody Generation i) Materials:

1) Complete Media No Sera (CMNS) for washing of the myeloma and spleen cells; Hybridoma medium CM—HAT {Cell Mab (BD), 10% FBS (or HS); 5% Origen HCF (hybridoma cloning factor) containing 4 mM L-glutamine and antibiotics} to be used for plating hybridomas after the fusion.

2) Hybridoma medium CM—HT (NO AMINOPTERIN) (Cell Mab (BD), 10% FBS 5% Origen HCF containing 4 mM L-glutamine and antibiotics) to be used for fusion maintenance are stored in the refrigerator at 4-6° C. The fusions are fed on days 4, 8, and 12, and subsequent passages. Inactivated and pre-filtered commercial Fetal Bovine serum (FBS) or Horse Serum (HS) are thawed and stored in the refrigerator at 4° C. and must be pretested for myeloma growth from single cells.

3) The L-glntamine (200 mM, 100× solution), which is stored at −20° C. freezer, is thawed and warmed until completely in solution. The L-glntamin is dispensed into media to supplement growth. L-glntamin is added to 2 mM for myelomas, and 4 mM for hybridoma media. Further the Penicillin, Streptomycin, Amphotericin (antibacterial-antifungal stored at −20° C.) is thawed and added to Cell Mab Media to 1%.

4) Myeloma growth media is Cell Mab Media (Cell Mab Media, Quantum Yield from BD is stored in the refrigerator at 4° C. in the dark) which are added L-glntamine to 2 mM and antibiotic/antimycotic solution to 1% and is called CMNS.

5) 1 bottle of PEG 1500 in Hepes (Roche, N.J.)

6) 8-Azaguanine is stored as the dried powder supplied by SIGMA at −700° C. until needed. Reconstitute 1 vial/500 ml of media and add entire contents to 500 ml media (eg. 2 vials/liter).

7) Myeloma Media is CM which has 10% FBS (or HS) and 8-Aza (1×) stored in the refrigerator at 4° C.

8) Clonal cell medium D (Stemcell, Vancouver) contains HAT and methyl cellulose for semi-solid direct cloning from the fusion. This comes in 90 ml bottles with a CoA and must be "melted at 37° C. in a waterbath in the morning of the day of the fusion. Loosen the cap and leave in CO2 incubator to sufficiently gas the medium D and bring the pH down.

9) Hybridoma supplements HT [hypoxanthine, thymidine] are to be used in medium for the section of hybridomas and maintenance of hybridomas through the cloning stages respectively.

10) Origen HCF can be obtained directly from Igen and is a cell supernatant produced from a macrophage-like cell-line. It can be thawed and aliqouted to 15 ml tubes at 5 ml per tube and stored frozen at −20° C. Positive Hybridomas are fed HCF through the first subcloning and are gradually weaned. It is not necessary to continue to supplement unless you have a particularly difficult hybridoma clone. This and other additives have been shown to be more effective in promoting new hybridoma growth than conventional feeder layers.

ii) Procedure

To generate monoclonal antibodies, mice are immunized with 5-50 ug of antigen either intra-peritoneally (i.p.) or by intravenous injection in the tail vein (i.v.). Typically, the antigen used is a recombinant protein that is generated as described above. The primary immunization takes place 2 months prior to the harvesting of splenocytes from the mouse and the immunization is typically boosted by i.v. injection of 5-50 ug of antigen every two weeks. At least one week prior to expected fusion date, a fresh vial of myeloma cells is thawed and cultured. Several flasks at different densities are maintained in order that a culture at the optimum density is ensured at the time of fusion. The optimum density is determined to be 3-6×$10^5$ cells/ml. Two to five days before the scheduled fusion, a final immunization is administered of ~5 ug of antigen in PBS i.p. or i.v.

Myeloma cells are washed with 30 ml serum free media by centrifugation at 500 g at 4° C. for 5 minutes. Viable cell density is determined in resuspended cells using hemocytometry and vital stains. Cells resuspended in complete growth medium are stored at 37° C. during the preparation of splenocytes. Meanwhile, to test aminopterin sensitivity, 1×$10^6$ myeloma cells are transferred to a 15 ml conical tube and centrifuged at 500 g at 4° C. for 5 minutes. The resulting pellet is resuspended in 15 ml of HAT media and cells plated at 2 drops/well on a 96 well plate.

To prepare splenocytes from immunized mice, the animals are euthanised and submerged in 70% ETOH. Under sterile conditions, the spleen is surgically removed and placed in 10 ml of RPMI medium supplemented with 20% fetal calf serum in a Petri dish. Cells are extricated from the spleen by infusing the organ with medium>50 times using a 21 g syringe.

Cells are harvested and washed by centrifugation (at 500 g at 4° C. for 5 minutes) with 30 ml of medium. Cells are resuspended in 10 ml of medium and the density of viable cells determined by hemocytometry using vital stains. The splenocytes are mixed with myeloma cells at a ratio of 5:1 (spleen cells: myeloma cells). Both the myeloma and spleen cells are washed 2 more times with 30 ml of RPMI-CMNS. Spin at 800 rpm for 12 minutes.

Supernatant is removed and cells are resuspended in 5 ml of RPMI-CMNS and are pooled to fill volume to 30 ml and spin down as before. Then, the pellet is broken up by gently tapping on the flow hood surface and resuspended in 1 ml of BMB REG1500 (prewarmed to 37° C.) dropwise with 1 cc needle over 1 minute.

RPMI-CMNS to the PEG cells and RPMI-CMNS are added to slowly dilute out the PEG. Cells are centrifuged and diluted in 5 ml of Complete media and 95 ml of Clonacell Medium D (HAT) media (with 5 ml of HCF). The cells are plated out 10 ml per small petri plate.

Myeloma/HAT control. P is prepared as follows: dilute about 1000 P3X63 Ag8.653 myeloma cells into 1 ml of medium D and transfer into a single well of a 24 well plate. Plates are placed in incubator, with two plates inside of a large petri plate, with an additional petri plate full of distilled water, for 10-18 days under 5% CO2 overlay at 37° C. Clones are picked from semisolid agarose into 96 well plates containing 150-200 ul of CM-HT. Supernatants are screened 4 days later in ELISA, and positive clones are moved up to 24 well plates. Heavy growth will require changing of the media at day 8 (+/−150 ml). One should further decrease the HCF to 0.5% (gradually −2%, then 1%, then 0.5%) in the cloning plates.

For further references see Kohler G, and C. Milstein Continuous cultures of fused cells secreting antibody of predefined specificity. 1975. Nature 256: 495-497; Lane, R. D. A short duration polyethylene glycol fusion technique for increasing production of monoclonal antibody-secreting hybridomas. 1985. J. Immunol. Meth. 81:223-228;

Harlow, E. and D. Lane. Antibodies: A laboratory manual. Cold Spring Harbour Laboratory Press. 1988; Kubitz, D. The Scripps Research Institute. La Jolla. Personal Communication; Zhong, G., Berry, J. D., and Choukri, S. (1996) Mapping epitopes of *Chlamydia trachomatis* neutralizing monoclonal antibodies using phage random peptide libraries. J. Indust. Microbiol. Biotech. 19, 71-76; Berry, J. D., Licea, A., Popkov, M., Cortez, X., Fuller, R., Elia, M., Kerwin, L., and C. F. Barbas III. (2003) Rapid monoclonal antibody generation via dendritic cell targeting in vivo. Hybridoma and Hybridomics 22 (1), 23-31.

6. mRNA Expression

Validation in Tissues by Taqman

Expression of mRNA is quantitated by RT-PCR using TaqMan® technology. The Taqman system couples a 5' fluorogenic nuclease assay with PCR for real time quantitation. A probe is used to monitor the formation of the amplification product.

Total RNA is isolated from disease model cell lines using the RNEasy Kit® (Qiagen) per manufacturer's instructions and included DNase treatment. Normal human tissue RNAs are acquired from commercial vendors (Ambion, Austin, Tex.; Stratagene, La Jolla, Calif., BioChain Institute, Newington, N.H.) as were RNAs from matched disease/normal tissues.

Target transcript sequences are identified for the differentially expressed peptides by searching the BlastP database. TaqMan assays (PCR primer/probe set) specific for those transcripts are identified by searching the Celera Discovery System™ (CDS) database. The assays are designed to span exon-exon borders and do not amplify genomic DNA.

The TaqMan primers and probe sequences are as designed by Applied Biosystems (AB) as part of the Assays on Demand™ product line or by custom design through the AB Assays by Design$^{SM}$ service.

RT-PCR is accomplished using AmpliTaqGold and MultiScribe reverse transcriptase in the One Step RT-PCR Master Mix reagent kit (AB) according to the manufacturer's instructions. Probe and primer concentrations are 250 nM and 900 nM, respectively, in a 15 μl reaction. For each experiment, a master mix of the above components is made and aliquoted into each optical reaction well. Eight nanograms of total RNA is the template. Each sample is assayed in triplicate. Quantitative RT-PCR is performed using the ABI Prism® 7900HT Sequence Detection System (SDS). Cycling parameters follow: 48° C. for 30 min. for one cycle; 95° C. for 10 min for one cycle; 95° C. for 15 sec, 60° C. for 1 min. for 40 cycles.

The SDS software calculates the threshold cycle ($C_T$) for each reaction, and $C_T$ values are used to quantitate the relative amount of starting template in the reaction. The $C_T$ values for each set of three reactions are averaged for all subsequent calculations Data are analyzed for fold difference in expression using an endogenous control for normalization and is expressed relative to a normal tissue or normal cell line reference. The choice of endogenous control is determined empirically by testing various candidates against the cell line and tissue RNA panels and selecting the one with the least variation in expression. Relative changes in expression are quantitated using the $2^{-\Delta\Delta CT}$ Method. Livak, K. J. and Schmittgen, T. D. (2001) Methods 25: 402-408; User bulletin #2: ABI Prism 7700 Sequence Detection System.

Validation by Tissue Flow Cytometry Analysis

Post tissue processing, cells are sorted by flow cytometry known in the art to enrich for epithelial cells. Alternatively, cells isolated from lung tissue are stained directly with EpCAM (for epithelial cells) and the specific antibody to a CAT. Cell numbers and viability are determined by PI exclusion (GUAVA) for cells isolated from both normal and tumor tissue. A minimum of $0.5\times10^6$ cells are used for each analysis. Cells are washed once with Flow Staining Buffer (0.5% BSA, 0.05% NaN3 in D-PBS). To the cells, 20 ul of each antibody for CAT are added. An additional 5 ul of EpCAM antibody conjugated to APC were added when unsorted cells are used in the experiment. Cells are incubated with antibodies for 30 minutes at 4° C. Cells are washed once with Flow Staining Buffer and either analyzed immediately on the LSR flow cytometry apparatus or fixed in 1% formaldehyde and store at 4° C. until LSR analysis. Antibodies used to detect a CAT may be purchased from BD Biosciences and PE-conjugated. The isotype control antibody used for these experiments is PE-conjugated mouse IgG1k.

7. Detection and Diagnosis of CAT by Liquid Chromatography and Mass Spectrometry (LC/MS)

The proteins from cells can be prepared by methods known in the art (R. Aebersold Nature Biotechnology Volume 21 Number 6 Jun. 2003).

The differential expression of proteins in disease and healthy samples are quantitated using Mass Spectrometry and ICAT (Isotope Coded Affinity Tag) labeling, which is known in the art. ICAT is an isotope label technique that allows for discrimination between two populations of proteins, such as a healthy and a disease sample that are pooled together for experimental purposes or two acquisitions of the same sample for classification of true sample peptides from LC/MS noise artifacts. The LC/MS spectra are collected for the labeled samples and processed using the following steps:

The raw scans from the LC/MS instrument are subjected to peak detection and noise reduction software. Filtered peak lists are then used to detect 'features' corresponding to specific peptides from the original sample(s). Features are characterized by their mass/charge, charge, retention time, isotope pattern and intensity.

Similar experiments are repeated in order to increase the confidence in detection of a peptide. These multiple acquisitions are computationally aggregated into one experiment. Experiments involving healthy and disease samples used the known effects of the ICAT label to classify the peptides as originating from a particular sample or from both samples. The intensity of a peptide present in both healthy and disease samples is used to calculate the differential expression, or relative abundance, of the peptide. The intensity of a peptide found exclusively in one sample is used to calculate a theoretical expression ratio for that peptide (singleton). Expression ratios are calculated for each peptide of each replicate of the experiment.

Statistical tests are performed to assess the robustness of the data and select statistically significant differentials. To assess general quality of the data, one: a) ensured that similar features are detected in all replicates of the experiment; b) assessed the distribution of the log ratios of all peptides (a Gaussian is expected); c) calculated the overall pair wise correlations between ICAT LC/MS maps to ensure that the expression ratios for peptides are reproducible across the multiple replicates; d) aggregated multiple experiments in order to compare the expression ratio of a peptide in multiple diseases or disease samples.

8. Expression Validation by Immunohistochemistry (IHC) in Tissue Sections

Tissue Sections

Paraffin embedded, fixed tissue sections are obtained from a panel of normal tissues (Adrenal, Bladder, Lymphocytes, Bone Marrow, Breast, Cerebellum, Cerebral cortex, Colon, Endothelium, Eye, Fallopian tube, Small Intestine, Heart, Kidney [glomerulus, tubule], Liver, Lung, Testes and Thyroid) as well as 30 tumor samples with matched normal adjacent tissues from pancreas, lung, colon, prostate, ovarian and breast. In addition, other tissues are selected for testing such as bladder renal, hepatocellular, pharyngeal and gastric tumor tissues. Replicate sections are also obtained from numerous tumor types (Bladder Cancer, Lung Cancer, Breast Cancer, Melanoma, Colon Cancer, Non-Hodgkins Lymphoma, Endometrial Cancer, Ovarian Cancer, Head and Neck Cancer, Prostate Cancer, Leukemia [ALL and CML] and Rectal Cancer). Sections are stained with hemotoxylin and eosin and histologically examined to ensure adequate representation of cell types in each tissue section.

An identical set of tissues will be obtained from frozen sections and are used in those instances where it is not possible to generate antibodies that are suitable for fixed sections. Frozen tissues do not require an antigen retrieval step.

Paraffin Fixed Tissue Sections

Hemotoxylin and Eosin staining of paraffin embedded, fixed tissue sections.

Sections are deparaffinized in 3 changes of xylene or xylene substitute for 2-5 minutes each. Sections are rinsed in 2 changes of absolute alcohol for 1-2 minutes each, in 95% alcohol for 1 minute, followed by 80% alcohol for 1 minute. Slides are washed well in running water and stained in Gill solution 3 hemotoxylin for 3 to 5 minutes. Following a vigorous wash in running water for 1 minute, sections are stained in Scott's solution for 2 minutes. Sections are washed for 1 min in running water then conterstained in Eosin solution for 2-3 minutes depending upon development of desired staining intensity. Following a brief wash in 95% alcohol, sections are dehydrated in three changes of absolute alcohol for 1 minute each and three changes of xylene or xylene substitute for 1-2 minutes each. Slides are coverslipped and stored for analysis.

Optimisation of Antibody Staining

For each antibody, a positive and negative control sample are generated using data from the ICAT analysis of the cancer cell lines/tissues. Cells are selected that are known to express low levels of a particular target as determined from the ICAT data. This cell line is the reference normal control. Similarly, a cancer cell line that is determined to over-express the target is selected.

Antigen Retrieval

Sections are deparaffinized and rehydrated by washing 3 times for 5 minutes in xylene; two times for 5 minutes in 100% ethanol; two times for 5 minutes in 95% ethanol; and once for 5 minutes in 80% ethanol. Sections are then placed in endogenous blocking solution (methanol+2% hydrogen peroxide) and incubated for 20 minutes at room temperature. Sections are rinsed twice for 5 minutes each in deionized water and twice for 5 minutes in phosphate buffered saline (PBS), pH 7.4: Alternatively, where necessary sections are deparrafinized by High Energy Antigen Retrieval as follows: sections are washed three times for 5 minutes in xylene; two times for 5 minutes in 100% ethanol; two times for 5 minutes in 95% ethanol; and once for 5 minutes in 80% ethanol. Sections are placed in a Coplin jar with dilute antigen retrieval solution (10 mM citrate acid, pH 6). The Coplin jar containing slides is placed in a vessel filled with water and microwaved on high for 2-3 minutes (700 watt oven). Following cooling for 2-3 minutes, steps 3 and 4 are repeated four times (depending on tissue), followed by cooling for 20 minutes at room temperature. Sections are then rinsed in deionized water, two times for 5 minutes, placed in modified endogenous oxidation blocking solution (PBS+2% hydrogen peroxide) and rinsed for 5 minutes in PBS.

Blocking and Staining

Sections are blocked with PBS/1% bovine serum albumin (PBA) for 1 hour at room temperature followed by incubation in normal serum diluted in PBA (2%) for 30 minutes at room temperature to reduce non-specific binding of antibody. Incubations are performed in a sealed humidity chamber to prevent air-drying of the tissue sections. (The choice of blocking serum is the same as the species of the biotinylated secondary antibody). Excess antibody is gently removed by shaking and sections covered with primary antibody diluted in PBA and incubated either at room temperature for 1 hour or overnight at 4° C. (Care is taken that the sections do not touch during incubation). Sections are rinsed twice for 5 minutes in PBS, shaking gently. Excess PBS is removed by gently shaking. The sections are covered with diluted biotinylated secondary antibody in PBA and incubated for 30 minutes to 1 hour at room temperature in the humidity chamber. If using a monoclonal primary antibody, addition of 2% rat serum is used to decrease the background on rat tissue sections. Following incubation, sections are rinsed twice for 5 minutes in PBS, shaking gently. Excess PBS is removed and sections incubated for 1 hour at room temperature in Vectastain ABC reagent (as per kit instructions). The lid of the humidity chamber is secured during all incunations to ensure a moist environment. Sections are rinsed twice for 5 minutes in PBS, shaking gently.

Develop and Counterstain

Sections are incubated for 2 minutes in peroxidase substrate solution that is made up immediately prior to use as follows:

10 mg diaminobenzidine (DAB) dissolved in 10 ml 50 mM sodium phosphate buffer, pH 7.4.

12.5 microliters 3% CoCl2/NiCl2 in deionized water 1.25 microliters hydrogen peroxide Slides are rinsed well three times for 10 min in deionized water and counterstained with 0.01% Light Green acidified with 0.01% acetic acid for 1-2 minutes depending on intensity of counterstain desired.

Slides are rinsed three times for 5 minutes with deionized water and dehydrated two times for 2 minutes in 95% ethanol; two times for 2 minutes in 100% ethanol; and two times for 2 minutes in xylene. Stained slides are mounted for visualization by microscopy.

9. IHC Staining of Frozen Tissue Sections

Fresh tissues are embedded carefully in OCT in plastic mold, without trapping air bubbles surrounding the tissue. Tissues are frozen by setting the mold on top of liquid nitrogen until 70-80% of the block turns white at which point the mold is placed on dry ice. The frozen blocks were stored at −80° C. Blocks are sectioned with a cryostat with care taken to avoid warming to greater than −10° C. Initially, the block is equilibrated in the cryostat for about 5 minutes and 6-10 mm sections are cut sequentially. Sections are allowed to dry for at least 30 minutes at room temperature. Following drying, tissues are stored at 4° C. for short term and −80° C. for long term storage.)

Sections are fixed by immersing in acetone jar for 1-2 minutes at room temperature, followed by drying at room temp. Primary antibody is added (diluted in 0.05 M Tris-saline [0.05 M Tris, 0.15 M NaCl, pH 7.4], 2.5% serum) directly to the sections by covering the section dropwise to cover the tissue entirely. Binding is carried out by incubation a chamber for 1 hour at room temperature. Without letting the sections dry out, the secondary antibody (diluted in Tris-saline/2.5% serum) is added in a similar manner to the primary and incubated as before (at least 45 minutes).

Following incubation, the sections are washed gently in Tris-saline for 3-5 minutes and then in Tris-saline/2.5% serum for another 3-5 minutes. If a biotinylated primary antibody is used, in place of the secondary antibody incubation, slides are covered with 100 ul of diluted alkaline phosphatase conjugated streptavidin, incubated for 30 minutes at room temperature and washed as above. Sections are incubated with alkaline phosphatse substrate (1 mg/ml Fast Violet; 0.2 mg/ml Napthol AS-MX phosphate in Tris-Saline pH 8.5) for 10-20 minutes until the desired positive staining is achieved at which point the reaction is stopped by washing twice with Tris-saline. Slides are counter-stained with Mayer's hematoxylin for 30 seconds and washed with tap water for 2-5 minutes. Sections are mounted with Mount coverslips and mounting media.

10. Assay for Antibody Dependent Cellular Cytotoxicity

Cultured tumor cells are labeled with 100 μCi 51Cr for 1 hour; Livingston, P. O., Zhang, S., Adluri, S., Yao, T.-J., Graeber, L., Ragupathi, G., Helling, F., & Fleischer, M. (1997). Cancer Immunol. Immunother. 43, 324-330. After being washed three times with culture medium, cells are resuspended at $10^5$/ml, and 100 μl/well are plated onto 96-well round-bottom plates. A range of antibody concentrations are applied to the wells, including an isotype control together with donor peripheral blood mononuclear cells that are plated at a 100:1 and 50:1 ratio. After an 18-h incubation at 37° C., supernatant (30 μl/well) is harvested and transferred onto Lumaplate 96 (Packard), dried, and read in a Packard Top-Count NXT γ counter. Each measurement is carried out in triplicate. Spontaneous release is determined by cpm of tumor cells incubated with medium and maximum release by cpm of tumor cells plus 1% Triton X-100 (Sigma). Specific lysis is defined as: % specific lysis=[(experimental release−spontaneous release)/(maximum release−spontaneous release)]×100. The percent ADCC is expressed as peak specific lysis postimmune subtracted by preimmune percent specific lysis. A doubling of the ADCC to >20% is considered significant.

11. Assay for Complement Dependent Cytotoxicity

Chromium release assays to assess complement-mediated cytotoxicity are performed for each patient at various time points; Dickler, M. N., Ragupathi, G., Liu, N. X., Musselli, C., Martino, D. J., Miller, V. A., Kris, M. G., Brezicka, F. T., Livingston, P. O. & Grant, S. C. (1999) Clin. Cancer Res. 5, 2773-2779. Cultured tumor cells are washed in FCS-free media two times, resuspended in 500 μl of media, and incubated with 100 μCi $^{51}$Cr per 10 million cells for 2 h at 37° C. The cells are then shaken every 15 min for 2 h, washed 3 times in media to achieve a concentration of approximately 20,000 cells/well, and then plated in round-bottom plates. The plates contain either 50 μl cells plus 50 μl monoclonal antibody, 50 μl cells plus serum (pre- and posttherapy), or 50 μl cells plus mouse serum as a control. The plates are incubated in a cold room on a shaker for 45 min. Human complement of a 1:5 dilution (resuspended in 1 ml of ice-cold water and diluted with 3% human serum albumin) is added to each well at a volume of 100 μl. Control wells include those for maximum release of isotope in 10% Triton X-100 (Sigma) and for spontaneous release in the absence of complement with medium alone. The plates are incubated for 2 h at 37° C., centrifuged for 3 min, and then 100 μl of supernatant is removed for radioactivity counting. The percentage of specific lysis is calculated as follows: % cytotoxicity [(experimental release-spontaneous release)/(maximum release-spontaneous release)]×100. A doubling of the CDC to >20% is considered significant.

12. In vitro Assays in Cell Lines

RNAi

Lipofectamine 2000 and Plus were purchased from Invitrogen (Carlsbad, Calif.) and GeneSilencer from Gene Therapy Systems (San Diego, Calif.). Synthetic siRNA oligonucleotides were from Dharmacon (Lafayette, Colo.), Qiagen (Valencia, Calif.). RNeasy 96 Kit was purchased from Qiagen (Valencia, Calif.). Apop-one homogeneous caspase-3/7 kit and CellTiter 96 AQueous One solution cell proliferation assay were both purchased from Promega (Madison, Wis.). Alamar Blue proliferation assay was purchased from Biosource (Camarillo, Calif.).

RNAi Transfections

In the initial screening phase, RNAi was performed by using 100 nM (final) of Smartpools (Dharmacon), pool of 4—for Silencing siRNA duplexes (Qiagen) or non-targeting negative control siRNA (Dharmacon or Qiagen). In the breakout phase, each individual duplex was used at 100 nM (final). In the titration phase, individual duplex were used at 0.1-100 nM (final). Transient transfections were carried out by using either Lipofectamine 2000 from Invitrogen (Carlsbad, Calif.) or by using GeneSilencer from Gene Therapy Systems (San Diego, Calif.) in methods described below. 1 day after transfections, total RNA was isolated by using the RNeasy 96 Kit (Qiagen) according to manufacturer's instructions and expression of mRNA was quantitated by using TaqMan technology. Apoptosis and proliferation assays were performed daily using Apop-one homogeneous caspase-3/7 kit and Alamar Blue or CellTiter 96 AQueous One Solution Cell Proliferation Assays (see below).

RNAi Transfections—Lipofectamine 2000

Transient transfections were carried out on sub-confluent cancer cell lines as previously described (Elbashir, S. M. et al. (2001) Nature 411: 494-498, Caplen, N. J. et al. (2001) Proc Natl Acad Sci USA 98: 9742-9747, Sharp, P. A. (2001) Genes and Development 15: 485-490). Synthetic RNA to gene of interest or non-targeting negative control siRNA were transfected using lipofectamine according to manufacturer's instructions. Cells were plated in 96 well plates in antibiotics free medium. The next day, the transfection reagent and siRNA were prepared for transfections as follows: For each well, 0.1-100 nM siRNA was resuspended in 25 ul serum-free media with Plus and incubated at room temperature for 15 minutes. 0.1-1 ul of lipofectamine 2000 was then resuspended in serum-free medium. After incubation, the diluted siRNA and the lipofectamine 2000 were combined and incubated for 15 minutes at room temperature. Media was then removed from the cells and the combined siRNA-Lipofectamine 2000 reagent added to a final volume of 50 ul per well. After a further 4 hours incubation, 50 ul serum containing medium was added to each well. 1 and 4 days after transfection, expression of mRNA was quantitated by RT-PCR using TaqMan technology and protein expression levels were examined by flow cytometry. Apoptosis and proliferation assays were performed daily using Apop-one homogeneous caspase-3/7 kit and Alamar Blue or CellTiter 96 AQueous One Solution Cell Proliferation Assays (see below).

RNAi Transfections—GeneSilencer

Transient transfections were carried out on sub-confluent cancer cell lines as previously described. Synthetic RNA to gene of interest or scrambled negative control siRNA were transfected using GeneSilencer according to manufacturer's instructions. Cells were plated in 96 well plates in antibiotics free medium. The next day, the transfection reagent and the synthetic siRNA were prepared for transfections as follows: 1-1.5 ul of Gene Silencer was diluted in serum-free media to a final volume of 20 ul per well. After resuspending 0.1-100 nM siRNA in 20 ul serum-free media, the reagents were combined and incubated at room temperature for 5-20 minutes. After incubation, the siRNA-Gene Silencer reagent was added to each well to a final volume of 50 ul per well. After further incubation in a 37° C. incubator for 4 hours, an equal volume of serum containing media was added back to the cultured cells. The cells were then incubated for 1 to 4 days before mRNA, protein expression and effects on apoptosis and proliferation were examined.

Apoptosis

Apoptosis assay was performed by using the Apop-one homogeneous caspase-3/7 kit from Promega. Briefly, the caspase-3/7 substrate was thawed to room temperature and diluted 1:100 with buffer. The diluted substrate was then added 1:1 to cells, control or blank. The plates were then placed on a plate shaker for 30 minutes to 18 hours at 300-500 rpm. The fluorescence of each well was then measured at using an excitation wavelength of 485+/−20 nm and an emission wavelength of 530+/−25 nm.

Proliferation—MTS

Proliferation assay was performed by using the CellTiter 96 AQueous One Solution Cell Proliferation Assay kit from Promega. 20 ul of CellTiter 96 AQueous One Solution was added to 100 ul of culture medium. The plates were then incubated for 1-4 hours at 37° C. in a humidified 5% CO2 incubator. After incubation, the change in absorbance was read at 490 nm.

Proliferation—Alamar Blue

Proliferation assay was performed by using the Alamar Blue assay from Biosource. 10 ul of Alamar Blue reagent was added to 100 ul of cells in culture medium. The plates were then incubated for 1-4 hours at 37° C. in a humidified 5% $CO_2$ incubator. After incubation, the change in fluorescence was measured at using an excitation wavelength of 530 nm and an emission wavelength of 595 nm.

mRNA Expression

Expression of mRNA was quantitated by RT-PCR using TaqMan® technology. Total RNA was isolated from cancer model cell lines using the RNEasy 96 kit (Qiagen) per manufacturer's instructions and included DNase treatment. Target transcript sequences were identified for the differentially expressed peptides by searching the BlastP database. TaqMan assays (PCR primer/probe set) specific for those transcripts were identified by searching the Celera Discovery System™ (CDS) database. The assays are designed to span exon-exon borders and do not amplify genomic DNA. The TaqMan primers and probe sequences were as designed by Applied Biosystems (AB) as part of the Assays on Demand™ product line or by custom design through the AB Assays by Design$^{SM}$ service. RT-PCR was accomplished using AmpliTaqGold and MultiScribe reverse transcriptase in the One Step RT-PCR Master Mix reagent kit (AB) according to the manufacturers instructions. Probe and primer concentrations were 900 nM and 250 nM, respectively, in a 25 μl reaction. For each experiment, a master mix of the above components was made and aliquoted into each optical reaction well. 5 ul of total RNA was the template. Each sample was assayed in triplicate. Quantitative RT-PCR was performed using the ABI Prism® 7900HT Sequence Detection System (SDS). Cycling parameters follow: 48° for 30 min. for one cycle; 95° C. for 10 min for one cycle; 95° C. for 15 sec, 60° C. for 1 min. for 40 cycles.

The SDS software calculates the threshold cycle (CT) for each reaction, and CT values were used to quantitate the relative amount of starting template in the reaction. The CT values for each set of three reactions were averaged for all subsequent calculations.

Total RNA was quantitated by using RiboGreen RNA Quantitation Kit according to manufacturer's instructions and the % mRNA expression was calculated using total RNA for normalization. % knockdown was then calculated relative to the no addition control.

Testing of Functional Blocking Antibodies

Sub-confluent lung cancer cell lines are serum-starved overnight. The next day, serum-containing media is added back to the cells in the presence of 5-50 ng/ml of function blocking antibodies. After 2 or 5 days incubation at 37° C. 5% $CO_2$, antibody binding is examined by flow cytometry and apoptosis and proliferation are examined by using protocols described below.

Cell Invasion

Cell invasion assay is performed by using the 96 well cell invasion assay kit available from Chemicon. After the cell invasion chamber plates are adjusted to room temperature, 100 ul serum-free media is added to the interior of the inserts. 1-2 hours later, cell suspensions of $1\times10^6$ cells/ml are prepared. Media is then carefully removed from the inserts and 100 ul of prepared cells are added into the insert +/−0 to 50 ng function blocking antibodies. The cells are pre-incubated for 15 minutes at 37° C. before 150 ul of media containing 10% FBS is added to the lower chamber. The cells are then incubated for 48 hours at 37° C. After incubation, the cells from the top side of the insert are discarded and the invasion chamber plates are then placed on a new 96-well feeder tray containing 150 ul of pre-warmed cell detachment solution in the wells. The plates are incubated for 30 minutes at 37° C. and are periodically shaken. Lysis buffer/dye solution (4 ul CyQuant Dye/300 ul 4× lysis buffer) is prepared and added to each well of dissociation buffer/cells on feeder tray. The plates are incubated for 15 minutes at room temperature before 150 ul is transferred to a new 96-well plate. Fluorescence of invading cells is then read at 480 nm excitation and 520 nm emission.

Receptor Internalization

For quantification of receptor internalization, ELISA assays are performed essentially as described by Daunt et al. (Daunt, D. A., Hurtz, C., Hein, L., Kallio, J., Feng, F., and Kobilka, B. K. (1997) Mol. Pharmacol. 51, 711-720.) The cell lines are plated at $6\times10^5$ cells per in a 24-well tissue culture dishes that have previously been coated with 0.1 mg/ml poly-L-lysine. The next day, the cells are washed once with PBS and incubated in DMEM at 37° C. for several minutes. Agonist to the cell surface target of interest is then added at a pre-determined concentration in prewarmed DMEM to the wells. The cells are then incubated for various times at 37° C. and reactions are stopped by removing the media and fixing the cells in 3.7% formaldehyde/TBS for 5 min at room temperature. The cells are then washed three times with TBS and nonspecific binding blocked with TBS containing 1% BSA for 45 min at room temperature. The first antibody is added at a pre-determined dilution in TBS/BSA for 1 hr at room temperature. Three washes with TBS followed, and cells are briefly reblocked for 15 min at room temperature. Incubation with goat anti-mouse conjugated alkaline phosphatase (Bio-Rad) diluted 1:1000 in TBS/BSA is carried out for 1 h at room temperature. The cells are washed three times with TBS and a colorimetric alkaline phosphatase substrate is added. When the adequate color change is reached, 100-μl samples are taken for colorimetric readings.

13. In Vivo Studies by Using Antibodies

Treatment of Cancer Cells with Monoclonal Antibodies.

Cancer cells are seeded at a density of $4\times10^4$ cells per well in 96-well microtiter plates and allowed to adhere for 2 hours. The cells are then treated with different concentrations of anti-CAT monoclonal antibody (Mab) or irrelevant isotype matched (anti-rHuIFN-.gamma. Mab) at 0.05, 0.5 or 5.0 mug/ml. After a 72 hour incubation, the cell monolayers are stained with crystal violet dye for determination of relative percent viability (RPV) compared to control (untreated) cells. Each treatment group consists of replicates. Cell growth inhibition is monitored.

Treatment of NIH3T3 Cells Overexpression CAT Protein with Monoclonal Antibodies.

NIH 3T3 expressing a CAT protein are treated with different concentrations of anti-CAT MAbs. Cell growth inhibition is monitored.

In Vivo Treatment of NIH 3 T3 Cells Overexpressing CAT with Anti-CAT Monoclonal Antibodies.

NIH 3T3 cells transfected with either a CAT expression plasmid or the neo-DHFR vector are injected into nu/nu (athymic) mice subcutaneously at a dose of $10^6$ cells in 0.1 ml of phosphate-buffered saline. On days 0, 1, 5 and every 4 days thereafter, 100 mug (0.1 ml in PBS) of either an irrelevant or anti-CAT monoclonal antibody of the IG2A subclass is injected intraperitoneally. Tumor occurrence and size are monitored for 1 month period of treatment.

14. Summary of Experimental Validation

Exemplary results of experimental validation studies for each target are provided in the Figures and are set forth below:

GFRa1

12 GFRa1 peptides were observed by mass-spec as over expressed in breast and kidney cancer cell lines, as follows: 19.2 to 127.3 fold over-expressed in breast cancer cell line and conditioned media, and 2.5 to 14 fold over-expressed in kidney cancer cell line.

Immunohistochemistry (IHC) confirms expression of GFRa1 in breast (9%) and kidney (10%) tumors (FIG. 1).

IHC analysis indicates that GFRa1 staining of breast cancer samples does not correlate with ER, PR or HER2 status (FIG. 3).

Overexpression of GFRa1 was observed, both by FACS and by Taqman, in breast cancer cell line MCF-7 and kidney cell line ACHN (FIG. 4). This correlates with over-expression of GFRa1 as observed by mass spec.

Elevated expression of GFRa1 mRNA was observed in breast tumors by TaqMan (FIGS. 5 and 18), correlating with elevated protein expression observed my mass-spec and IHC. GFRa1 kinase binding partner (Ret) mRNA and GFRa1 ligand (GDNF) mRNA were also over-expressed in breast tumors (FIGS. 19-20).

GFRa1 ligand (GDNF) is expressed in MCF-7 breast cancer cells (FIG. 17). Both GFRa1 and it's kinase binding partner (Ret) are expressed in MCF7 and HCC1937 breast cancer cells (FIG. 21). GFRa1 is also expressed in ACHN and Caki 1 kidney cancer cell lines (FIG. 24), and in breast cancer cell lines and tumors (FIG. 26).

Functional data indicates that GFRa1 siRNA inhibits proliferation (35%) and induces apoptosis (3.4 fold) of Caki-1 kidney cancer cell lines (FIGS. 6-8), and also inhibits proliferation in lung cancer cells (FIG. 6).

Functional data indicates that recombinant GFRa1 ligand (GDNF) increases proliferation of MCF-7 breast cancer cells (FIGS. 9, 22-23, and 33). However, heat-denatured GFRa1 ligand does not induce MCF-7 cell proliferation (FIG. 28).

A monoclonal antibody to GFRa1 ligand (GDNF) blocks binding of GFRa1 ligand (FIG. 30). Furthermore, GFRa1 ligand-mediated MCF-7 cell proliferation is blocked by neutralizing anti-GFRa1 ligand antibodies (FIG. 31).

Effect of GFRa1 ligand/GFRa1 antagonists on MCF-7 breast cancer cell proliferation in complete growth medium (no exogenous GFRa1 ligand) is shown in FIG. 32.

Inhibitors (e.g., small molecule kinase inhibitor compounds) of GFRa1 kinase binding partner (Ret) inhibit proliferation induced by GFRa1 ligand (GDNF) in MCF-7 breast cancer cells (FIG. 10).

GFRa1 peptide blocks 20 ng/ml GDNF (GFRa1 ligand) mediated MCF-7 breast cancer cell proliferation (FIG. 25).

GFRa1 kinase binding partner (Ret) but not GFRa1 is expressed in ASPC-1 and BXPC-3 pancreatic cancer cells (FIG. 27).

IHC and Taqman indicated limited normal tissue expression of GFRa1. Elevated expression of GFRa1 was observed in the following normal cells and tissues: brain, ganglion cells, and lymphocytes.

Claudin-4

A Claudin-4 peptide was observed by mass spec as over-expressed in breast and gastric cancer cell lines (11.8-fold over-expressed in breast cancer cell line and 33.2-fold over-expressed in gastric cancer cell line).

Immunohistochemistry (IHC) indicates that Claudin-4 is over-expressed in multiple tumor types, as follows: breast (over-expressed in 50% of tumors), ovarian (40%), and lung (20%) (FIG. 35). Specifically, Claudin-4 was over-expressed in 5 out of 10 breast cancer specimens, 4 out of 10 ovarian cancer specimens, and 2 out of 10 lung cancer specimens, as indicated by IHC.

Claudin-4 is localized mostly at the membrane of tumor epithelial cells, as indicated by IHC.

ASCT2

Five ASCT2 peptides were observed by mass spec as over-expressed in colon and gastric tumor tissues as well as in pancreatic, colon, lung, breast, liver, melanoma and gastric cancer cell lines, as follows: 2.2-20.2-fold over-expressed in breast cancer cell lines, 5.1-6.0 fold in colon cancer cell line, 4.5-13.0 fold in colon cancer tissues, 2.8 fold in kidney cancer endothelial cells, 3.1-6.6 fold in liver cancer cell lines, 8.0-22.7 fold in lung cancer cell lines, 4.0-9.0 fold in pancreatic cancer cell line, 3.7-18.3 fold in melanoma cell lines, 14.0-28.7 fold in gastric cancer cell lines, and 27.3-44.2 fold in gastric cancer tissue. ASCT2 was also over-expressed in renal endothelial cells.

IHC confirmed expression of ASCT2 in colon, lung, pancreatic, liver and gastric tumors. ASCT2 was over-expression in multiple tumor types, as indicated by IHC, as follows: metastatic pancreas (43%), prostate (40%), ovary (30%), and pancreas (22%) (FIG. 36).

For IHC, a commercially available rabbit polyclonal antibody raised against an amino terminal peptide and an internally generated rabbit polyclonal antibody raised against a peptide (amino acids 515-530 of ASCT2) were used.

mRNA expression analysis indicates over-expression of ASCT2 in pancreatic tumors (FIG. 37).

Knockdown of ASCT2 mRNA inhibited proliferation of pancreatic (40%), and colon cancer cells, as well as breast cancer cells (FIGS. 38-40).

CD166-ALCAM

15 CD166 peptides were observed by mass-spec as over expressed in lung, colon and AML tissues and breast, gastric, kidney, lung, prostate and pancreatic cancer cell lines, as follows: 2.4 to 145.4 fold over-expressed in breast cancer cell lines and conditioned media, 3.5 to 6 fold in colon tissues, 3.6 to 26.4 fold in gastric cell line, 4.6 fold in kidney cancer cell line, 3.2 to 61.7 fold in lung cancer tissues cell lines and conditioned medium from lung cancer cell line, 4.4 to 27.2 fold in prostate cancer cell lines and conditioned media, 5 to 19.8 fold in pancreatic cancer cell lines, and 3.2 to 7.3 fold in AML primary cells.

IHC confirms expression of CD166 in breast and colon tumors. IHC indicates that CD166 is over-expressed by 2 pathology grades in multiple tumor specimens, as follows: breast (40%), bladder (30%), and colon (20%) (FIG. 42).

Fluorescence-activated cell sorting (FACS) indicates over-expression of CD166 in multiple cell lines (breast, colon, and pancreas) and tumor tissues (lung and colon) (FIGS. 43-44).

Elevated CD166 mRNA expression was observed in breast and colon tumor tissues, and in pancreatic cell lines (FIGS. 45-47).

Functional data indicates that CD166 siRNA inhibits proliferation of ASPC-1 pancreatic cancer cell lines (33%), HT29 and HCT116 colon cancer cell lines (35 to 64%), MCF-7 breast cancer cell lines (36%), Caki-1 kidney cancer cell lines (59%), and AGS and NCI-N87 gastric cancer cell lines (48 to 61%) (FIGS. 48, 50-53).

Functional data indicates that CD166 siRNA induces apoptosis of HCT116 and HT29 colon cancer cell lines (1.5 to 2.8 fold) and AGS gastric cancer cell lines (2 fold) (FIGS. 49-50, 52).

CD166 siRNA in combination with Gemzar can enhance apoptosis of BXPC-3 pancreatic cancer cells (FIG. 54).

Saporin-conjugated 2nd Ab+CD166 mAb induces cell death in CD166 positive HCC1954 breast cells, but does not induce cell death in CD166 negative HCC1937 breast cells (FIGS. 55-60).

High expression of CD166 was observed in the following normal cells and tissues: Adrenal Medulla, Liver Bile duct epithelium and peripheral nerves, Lung Airway, Ovary Follicle, Pancreas Islet of Langerhans, Prostate, Small Intestine Ganglion cell and Peripheral Nerves, Thymus Epithelium, and Uterus Endometrium

CD55

10 CD55 peptides were observed by mass spec as over-expressed in 22 cancer cell lines and 15 tumor tissues, as follows: 2.4-14.5 fold over-expressed in breast cancer cell lines, 4.6-100 fold in colon tissues, 3.0-19.9 fold in kidney cancer cell lines, 4.8-6.3 fold in liver cancer cell lines, 4.3-111.7 fold in lung cancer cell lines, 6.3 fold in lung cancer cell line conditioned medium, 2.4-10 fold in lung tissues, 100 fold in pancreatic cancer cell line conditioned medium, 7 fold in prostate cell line, 4.9 fold in melanoma cell line, and 9.3-49.7 fold in gastric cell lines.

IHC indicates over expression of CD55 in multiple tumors types, as follows: colon (30%), lung (squamous) (30%), melanoma, lymph node (30%), bladder (20%), pancreas (20%), and lung (adenocarcinoma) (10%) (FIGS. 62 and 81).

Over-expression of CD55 mRNA was observed in colon and pancreatic tumor tissue (FIGS. 66 and 73-78).

QFACS confirms over-expression of CD55 in 100% of colon tumors relative to normal colon using a commercially available monoclonal antibody (FIGS. 63-65).

Knockdown of CD55 mRNA inhibits proliferation in multiple cell lines (35%), including colon and prostate cancer cell lines (FIG. 67). Functional data also indicate that CD55 siRNA inhibits proliferation of HCT116 colon cancer cell line (90%) (FIG. 68).

TG2

11 TG2 peptides were observed by mass spec as over-expressed in lung, colon and kidney tumors; lung, colon, kidney, breast, prostate and pancreatic cancer cell lines and lung conditioned media, as follows: 2-21 fold over-expressed in lung tumor samples, 3-19 fold in lung cancer cell lines, 5 fold in lung conditioned media, 4-5 fold in colon tumor samples, 10-12 fold in a colon cancer cell line, 3-6 fold in pancreatic cancer cell lines, 16 fold in a breast cancer cell line, 3-15 fold in kidney cancer cell lines, 7-15 fold in kidney tumor samples, and 4 fold in a prostate cancer cell line.

TG2 was over-expressed, as indicated by IHC, in multiple tumor types, as follows: metastatic pancreatic tumors (100%), liver (50%), pancreas (44%), lung, NSC (20%), ovarian (20%), pharyngeal (20%), prostate (10%), gastric (10%), and esophageal (10%) (FIG. 83). TG2 showed limited expression in normal tissues, as measured by IHC and TaqMan.

Knockdown of TG2 mRNA inhibits proliferation in MPANC96 and BXPC-3 pancreatic (29 and 49%), Calu-1 lung (35%), and HT29 colon cancer cell lines (83%) (FIGS. 85-88).

TG2 mRNA over-expression was observed in pancreatic and colorectal tumor tissue.

TG2 was over-expressed in skin wound healing granulation tissue, as indicated by IHC.

CRA032197 (a specific small molecule inhibitor of TG2) blocked A549 lung tumor cell line and HUVEC proliferation.

CRA31033 and CRA032197 inhibited A549 xenograft tumor growth in a dose dependent fashion.

CD49f

13 CD49f peptides observed by mass spec as over-expressed in colon, kidney and gastric tumors and prostate, lung, colon, breast, kidney, gastric, liver and melanoma cancer cell lines, as follows: 3-48 fold over-expressed in colon tumors, 4-10 fold in colon cell lines, 4-21 fold in lung cell lines, 2-16 fold in breast cell lines, 9 fold in a kidney cell line, 3-4 fold in kidney tumors, 9 fold in a melanoma cell line, 6-14 fold in liver cell lines, 3-26 fold in prostate cell lines, 3-43 fold in gastric cell lines, and 8-23 fold in gastric tumors.

CD49f is over-expressed in multiple tumor types, as indicated by IHC, as follows: Kidney (100%), Lung, NSC (80%), Lung, Squamous (70%), Pancreas, Metastatic (67%), Melanoma, Lymph node (50%), Skin, Melanoma (50%), Brain, Glioblastoma (50%), Gastric (40%), Liver (38%), Pancreas (29%), Ovarian (20%), and Colon (20%) (FIG. 90).

CD49f is over-expressed in colon tumors (FIGS. 91-92).

Functional data indicates that CD49f siRNA inhibits proliferation of two lung cell lines (35% and 47%), two colon cell lines (32% and 68%), and a gastric cell line (46%) (FIGS. 93-96).

Anti-CD49f antibody blocked H1299 lung tumor cell line proliferation (FIG. 97).

QFACS data indicate over-expression of CD49f in colon tumor epithelial.

CD49f is Over-expressed in Melanoma Cell Lines as Measured by FACS.

CD98

CD98 peptides were observed by mass spec as over-expressed in lung and colon tumor tissues and lung, kidney, gastric, breast, liver, melanoma, esophageal and pancreatic cancer cell lines, as follows: 4.5 fold-singleton over-expressed in colon tumor tissues, 2.9-239.5 fold over-expressed in lung tumor tissues and cancer cell lines, 3.6-10.2 fold in kidney cancer cell lines, 10.9-13.6 fold in stomach cancer cell lines, 3.2-7 fold in breast cancer cell lines, 3.5-11.3 fold in liver cancer cell lines, 5.2-6.3 in melanoma cell lines, 145.6 fold in esophageal cancer cell line, and 5.2 fold in pancreatic cancer cell line.

IHC indicates over-expression of CD98 in multiple tumor types, as follows: Lung adeno (100%), Lung squamous (100%), Melanoma (90%), Glioblastoma (83%), Colon (80%), and Breast (50%) (FIG. 99).

QFACS confirms over-expression of CD98 in lung and colon tumors (FIGS. 101 and 104), which is consistent with results from mass spec and IHC.

Knockdown of CD98 inhibits proliferation in lung cancer cells, as well as pancreas and breast cancer cells (FIGS. 106-109).

CD104

4 CD104 peptides were observed by mass spec as over-expressed in tumor tissues (colon, lung, kidney, and gastric) and cancer cell lines (pancreatic, colon, lung, breast, kidney and gastric), as follows: 46-67 fold over-expressed in 1 pancreatic cell line, 2-42 fold in multiple colon tissues, 3-5 fold in 1 colon cell line, and as a singleton in 1 colon cell line, 2-4 fold in 1 breast cell line, 3 fold in 1 lung tissue, 3-23 fold in 3-lung cell lines, 3-4 fold in 1 kidney tissue, 4-8 fold in 2 kidney cell lines, 4-32 fold in 1 gastric tissue, and 6-38 fold in nonmetastatic gastric cell lines compared to metastatic gastric cell lines.

IHC confirms over-expression of CD104 in multiple tumor types, as follows: pancreas (40%) and colon (10%), and by 2 pathology grades in pancreas (30%) and colon (10%) (FIG. 111). IHC also indicated over-expression of CD104 in breast, liver, pancreas, and gastric tumors (FIG. 112). The antibody used for IHC analysis of CD104 was a mouse monoclonal antibody raised against the cytoplasmic domain of CD104.

Over-expression of CD104 mRNA was observed in pancreatic and colon tumor tissues, as indicated by Taqman analysis (FIG. 114).

Knockdown of CD104 mRNA inhibits proliferation in colon and breast cancer cell lines (FIGS. 115-116).

Over-expression of CD104 in colon tumors, as indicated by QFACS (FIG. 113), confirms mass spec and IHC results.

DPEP1

Four DPEP1 peptides were observed by mass spec as over-expressed in 40% of colon tumor tissues (2.7-100 fold over-expressed in colon tissues).

IHC indicates over-expression of DPEP1 in 20% of colon tumors (FIG. 118). DPEP1 was expressed at an intensity level of two in surface epithelium of normal colon, as indicated by IHC.

FACS confirms over-expression of DPEP1 on 45% of colon tumor tissues relative to normal colon using an internally generated monoclonal antibody (FIG. 119).

Over-expression of DPEP1 mRNA was observed in colorectal tumor tissue (FIG. 120).

Knockdown of DPEP1 mRNA inhibits proliferation of colon cancer cell lines (72% and 56%) (FIGS. 121, 123-124) and induces apoptosis of a colon cancer cell line (2.2 fold) (FIGS. 122-123).

A monoclonal antibody to DPEP1 inhibits proliferation in colon cancer cells (FIG. 125).

Tissue Factor (TF)

3 TF peptides were observed by mass spec as over-expressed in pancreatic, lung and breast cancer tumor cell lines, as follows: 3.5-7.6 fold over-expressed in breast cancer cell lines, 10.3 fold in conditioned medium from breast cancer cell line, 2.5-4.2 fold in lung cancer cell lines, and 5.1-75.0 fold over-expressed in pancreatic cancer cell lines.

TF is overexpressed by 2 pathology grades in multiple tumor types, as follows (as indicated by IHC): pancreatic cancer (72%), metastatic pancreatic tumors (67%), liver cancer (40%), prostate cancer (20%) and colorectal adenocarcinomas (10%) (FIG. 128).

Cell surface overexpression of TF was confirmed by FACS in pancreatic and colorectal cell lines and lung tumor specimens (FIG. 137)

mRNA profiling indicated over-expression of TF mRNA in pancreatic and lung tumor tissues (FIGS. 131 and 136).

Knockdown of TF mRNA inhibits proliferation in pancreatic, lung, colon, gastric and prostate cell lines (FIGS. 132-134).

TF ligand activates the AKT signaling pathway (FIG. 135).

TF demonstrated limited expression in normal tissues, as indicated by IHC and Taqman.

QFACS indicated TF cell surface copy number>2.5×105 in pancreatic cell lines.

Na-K ATPase Beta3

Six Na-K ATPase β3 peptides were observed by mass-spec as over-expressed in multiple lung, colon and kidney tissues and lung, colon and pancreatic cancer cell lines, as follows: 3.4 to 23.5 fold over-expressed in lung cancer cell lines and tissues, 6.7 to 9.3 fold in colon cell line and tissue, 4.2 to 9.1 fold in kidney tissue, and 100 fold (singleton) in pancreatic cell line.

IHC confirms expression of Na-K ATPase β3 in lung and pancreatic tumors.

IHC indicates overexpression of Na-K ATPase β3 by 2 pathology grades in multiple tumor specimens, as follows: Brain (83%), Lung, NSC (80%), Pancreas (71%), Breast (70%), Melanoma (70%), Melanoma, Lymph Node (70%), Metastatic Pancreatics (67%), Lung, Squamous (60%), Colon (50%), Ovary (50%), Liver (38%), and Gastric (30%) (FIG. 139).

Taqman indicates overexpression of Na-K ATPase β3 mRNA in multiple pancreatic tumors and several pancreatic cancer cell lines.

Functional data indicates that Na-K ATPase β3 siRNA inhibits proliferation of ASPC-1 and MPANC96 pancreatic cell lines (51 to 56%), Calu-1 lung cell lines (28%), HCT116 colon cell line (84%), and Caki-1 kidney cell lines (52%) (FIGS. 141 and 143-145).

Functional data indicates that Na-K ATPase β3 siRNA induces apoptosis of ASPC-1 and MPANC96 pancreatic cell lines (1.9 to 2.9 fold), Calu-1 lung cell lines (2.2 fold), MCF-7 breast cell lines (1.7 fold), Caki-1 kidney cell lines (5.8 fold), and AGS and NCI-N87 gastric cell lines (1.6 fold) (FIGS. 142-145).

Anti-Na-K ATPase β3 antibody inhibits cell proliferation in ASPC-1 and BXPC-3 pancreatic cancer cells (FIG. 146).

Na-K ATPase β3 siRNA in combination with Gemzar increases apoptosis of BXPC-3 pancreatic cancer cells (FIG. 147).

High expression of Na-K ATPase β3 was observed in the following normal cells and tissues: adrenal medulla, bone marrow erythroid and myeloid precursors, PBLs, platelets, epithelium of the esophagus, kidney, testis, pharynx, and prostate.

VIPR1

A VIPR1 peptide was observed by mass spec as over-expressed in breast and melanoma cancer cell lines (2.3-16 fold over-expressed in breast cancer cell lines and 6 fold over-expressed in melanoma cancer cell line).

IHC indicates over-expression of VIPR1 in multiple tumors types, as follows: Non-Hodgkin's Lymphoma, Lymph Nodes (100%), Bladder (50%), Lung (Squamous) (40%), Ovary (40%), Liver (38%), Metastatic Pancreatic (33%), Esophageal (20%), and Pharyngeal (20%) (FIG. 149).

Knockdown of VIPR1 mRNA inhibits cell proliferation in lung, colon, breast and gastric cell lines (FIGS. 151-154).

Antibody to VIPR1 inhibits proliferation in colon and breast cancer cells (FIG. 155).

CD26

12 CD26 peptides were observed by mass spec as over-expressed in colon, kidney, lung, and gastric tumor tissues and cell lines, and in liver and prostate cell lines, as follows: 13.8 fold over-expressed in colon cell line, 2.3-100 fold in colon tissues, 3.8-43.92 fold in kidney cell lines, 3.3 fold in kidney tissue, 13.4-18.6 fold in liver cell lines, 8 fold in lung cell line, 5-30.2 fold in lung tissues, 4.9-11.2 fold in prostate cell lines, 4.7-20 fold in gastric cell lines, and 36.2 fold in gastric tissue.

IHC indicates over-expression of CD26 in multiple tumor types, as follows: colon (50%), prostate (30%), non-Hodgkin's lymphoma (17%), and kidney (10%) (FIG. 157).

FACS indicates that CD26 is over-expressed in colon and lung tumor tissues relative to normal tissue (FIGS. 159-160).

Knockdown of CD26 mRNA inhibits cell proliferation in lung (31% and 50%), gastric (41 and 34%), colon (42%), breast (30%), and kidney (29%) cancer cells (FIGS. 162 and 164-167).

Knockdown of CD26 inhibits proliferation and induces apoptosis in H1299-HES spheroid cancer cells (cancer stem cells) (FIGS. 163 and 168).

Monoclonal antibody to CD26 inhibits cell proliferation in lung and colon cancer cell lines (FIG. 169).

CXADR

4 CXADR peptides were observed by mass-spec as over-expressed in breast, kidney, and lung cancer cell lines and in colon tumor tissues, as follows: 4-100 fold over-expressed in 2 breast cancer cell lines, 3-100 fold in 6 colon tumor tissues, 6-14 fold in a kidney cancer cell line, and 7 fold in a lung cancer cell line.

IHC indicates over-expression of CXADR in multiple tumors, as follows: non-Hodgkin's lymphoma (67%), Ovarian (60%), Brain glioblastoma (17%), Liver (13%), and Colon (FIG. 171).

CXADR mRNA over-expression was observed in colon tumor tissue (FIGS. 174 and 179).

Knockdown of CXADR mRNA mediates a decrease in proliferation in H1299 and Calu-1 lung (25%), HCT116 and HT29 colon (70 and 45%), and NCI-N87 gastric (39%) cancer cell lines (FIGS. 175-177).

Functional validation results support over expression of CXADR in colon and lung tumors as indicated by mass spec.

Anti-CXADR monoclonal antibody reduces proliferation in colon and lung cancer cell lines (FIG. 178).

CXADR expression was observed by FACS on colon and lung cancer cell lines (FIG. 172) and breast tumor tissue. CXADR was also over-expressed in 3D spheroid cancer cells (cancer stem cells) derived from a kidney cancer cell line (FIG. 173).

Mass spec cross-tissue analysis of CXADR reveals elevated expression of CXADR in breast, kidney, and colon tumors.

PTK7

13 PTK7 peptides were observed by mass-spec as over-expressed in prostate, kidney, lung, breast, and gastric cancer cell lines and in gastric cancer tissue and breast conditioned media (CM), as follows: 38 fold over-expressed in a prostate cell line, 17 fold in a kidney cell line, 5-70 fold in lung cancer cell lines, 3-15 fold in breast cancer cell lines, 7-32 in gastric cell lines, 5 fold in a gastric tissue, and 6-15 fold over-expressed in breast CM.

PTK7 is over-expressed in multiple tumor types, as indicated by IHC, as follows: Prostate (70%), Brain, Glioblastoma (67%), and Kidney (50%), as well as Colon (10%) and Bladder (10%) (FIG. 183). IHC also indicated over-expression of PTK7 in lung tumor tissues (PTK7 was expressed in 7 out of 10 lung tumor specimens).

Over-expression of PTK7 mRNA was observed (by TaqMan) in multiple cancer cell lines and tissues including prostate, lung, and colon (FIG. 187).

Knockdown of PTK7 mRNA inhibits proliferation of the following cancer cell lines: Calu1 Lung cell line (31%), H1299 lung cell line (58%), HCT116 colon cell line (71%), MPANC96 pancreatic cell line (39%), ACHN kidney cell line (37%) and NCI-N87 gastric cell line (48%) (FIGS. 188, 190-191)).

Knockdown of PTK7 mRNA induces apoptosis of the following cancer cells lines: Calu1 Lung cell line (85%), H1299 lung cell line (865%), ASPC-1 pancreatic cell line (50%), Caki-1 kidney cell line (68%), and prostate (2.4 fold) (FIGS. 189-190).

A rabbit polyclonal antibody to PTK7 blocked cell proliferation in H1299 lung tumor cell line (FIG. 192).

PTK7 is expressed in a hormone-refractory prostate xenograft model (FIGS. 184 and 195).

PTK7 expression was observed on 3D tumor spheroid cells (cancer stem cells) (FIGS. 186, 194, and 203).

PTK7 is expressed on prostate cancer cell lines, as measured by flow cytometry (FIGS. 196-201).

PTK7 mRNA expression in prostate tumors and normal tissues demonstrates two populations in prostate tumors (FIG. 202).

PTK7 is expressed in the following normal tissues: cardiac myocytes, pancreatic islets, hepatocytes, and bone marrow precursors.

MISTR

Two MISTR peptides were observed by mass spec as over-expressed in breast and prostate cancer cell lines, as follows: 3.3-8.8 fold over-expressed in breast cancer cell lines and 2.0-4.9 fold over-expressed in prostate cancer cell lines.

IHC indicates over-expression of MISTR in multiple tumors types, as follows: Ovary (90%), Liver (75%), Colon (70%), Lung (NSC), (70%), Breast (50%), Pancreas (38%), and Metastatic Pancreatic (100%). IHC also indicated over-expression of PTK7 in lung tumor tissues (PTK7 was expressed in 7 out of 10 lung tumor specimens) (FIG. 206).

Over-expression of MISTR mRNA was observed in pancreatic, colon, and ovarian tumor tissue (FIG. 207).

Knockdown of MISTR mRNA inhibits proliferation in pancreatic (38-54%), lung (28-39%), colon (72-95%), kidney (59%) and gastric cell lines (47%) (FIGS. 208 and 210-211).

Knockdown of MISTR mRNA induces apoptosis in pancreatic (2 fold), lung (1.4 fold), and colon (1.5-2.1 fold) cell lines (FIG. 209).

An antibody to MISTR inhibits proliferation in lung cancer cells (FIG. 212).

All publications and patents mentioned in the above specification are herein incorporated by reference. Various modifications and variations of the described method and system of the invention will be apparent to those skilled in the art without departing from the scope and spirit of the invention. Although the invention has been described in connection with specific preferred embodiments, it should be understood that the invention as claimed should not be unduly limited to such specific embodiments. Indeed, various modifications of the above-described modes for carrying out the invention, which are obvious to those skilled in the field of molecular biology or related fields, are intended to be within the scope of the following claims.

SEQUENCE LISTING (203 sequences)

SEQ ID NO: 1 - protein, 463 aa, Homo sapiens [sequence omitted]

SEQ ID NO: 2 - protein, 462 aa, Homo sapiens [sequence omitted]

SEQ ID NO: 3 - protein, 465 aa, Homo sapiens
MFLATLYFALPLLDLLLSAEVSGGDRLDCVKASDQCLKEQSCSTKYRTLRQCVAGKETNFSLASGLEAKDECRSAMEALKQKSLYNCRCKRGMKKEKNCLRIYWSMYQSLQGNDLLEDSPYEPVNSRLSDIFRVVPFISDVFQQVEHIPKGNNCLDAAKACNLDDICKKYRSAYITPCTTSVSNDVCNRRKCHKALRQFFDKVPAKHSYGMLFCSCRDIACTERRRQTIVPVCSYEEREKPNCLNLQDSCKTNYICRSRLADFFTNCQPESRSVSSCLKENYADCLLAYSGLIGTVMTPNYIDSSSLSVAPWCDCSNSGNDLEECLKFLNFFKDNTCLKNAIQAFGNGSDVTVWQPAFPVQTTTATTTTALRVKNKPLGPAGSENEIPTHVLPPCANLQAQKLKSNVSGNTHLCISNGNYEKEGLGASSHITTKSMAAPPSCGLSPLLVLVVTALSTLLSLTETS

SEQ ID NO: 4 - protein, 460 aa, Homo sapiens
MFLATLYFALPLLDLLLSAEVSGGDRLDCVKASDQCLKEQSCSTKYRTLRQCVAGKETNFSLASGLEAKDECRSAMEALKQKSLYNCRCKRGMKKEKNCLRIYWSMYQSLQGNDLLEDSPYEPVNSRLSDIFRVVPFISVEHIPKGNNCLDAAKACNLDDICKKYRSAYITPCTTSVSNDVCNRRKCHKALRQFFDKVPAKHSYGMLFCSCRDIACTERRRQTIVPVCSYEEREKPNCLNLQDSCKTNYICRSRLADFFTNCQPESRSVSSCLKENYADCLLAYSGLIGTVMTPNYIDSSSLSVAPWCDCSNSGNDLEECLKFLNFFKDNTCLKNAIQAFGNGSDVTVWQPAFPVQTTTATTTTALRVKNKPLGPAGSENEIPTHVLPPCANLQAQKLKSNVSGNTHLCISNGNYEKEGLGASSHITTKSMAAPPSCGLSPLLVLVVTALSTLLSLTETS

SEQ ID NO: 5 - DNA, 3396 bp, Homo sapiens
cagaacactgcgtgtcctgtgcgcgcgtacgggtccggccgcgggtcccaccgcaagcgggcgtgtgcagctgcggctgcctggcgggcgagcttaggagggagctggagctgcggagcggcgggaacaggagcaggccgagggtcctctggccagaagaaatctggcctcggaacacgccattctccgcgccgcttccaataaccactaacatccctaacgagcatccgagccgagggctctgctcggaaatcgtcctggcccaactcggcccttcgagctctcgaagattaccgcatctattttttttttcttttttttcttttcctagcgcagataaagtgagcccggaaagggaaggagggggcggggacaccattgccctgaaagaataaataagtaaataaacaaactggctcctcgccgcagctggacgcggtcggttgagtccaggttgggtcggacctgaacccctaaaagcggaaccgcctcccgccctcgccatcccggagctgagtcgccggcggcggtggctgctgccagacccggagtttcctctttcactggatggagctgaactttgggcggccagagcagcacagctgtccggggatcgctgcatgctgagctccctcggcaagacccagcggcggctcgggatttttttgggggggcggggaccagccccgcgccggcaccatgttcctggcgaccctgtacttcgcgctgccgctcttggacttgctcctgtcggccgaagtgagcggcggagaccgcctggattgcgtgaaagccagtgatcagtgcctgaaggagcagagctgcagcaccaagtaccgcacgctaaggcagtgcgtggcgggcaaggagaccaacttcagcctggcatccggcctggaggccaaggatgagtgccgcagcgccatggaggccctgaagcagaagtcgctctacaactgccgctgcaagcggggtatgaagaaggagaagaactgcctgcgcatttactggagcatgtaccagagcctgcagggaaatgatctgctggaggattccccatatgaaccagttaacagcagattgtcagatatattccgggtggtcccattcatatcagcatttgcagtggagcacattcccaaagggaacaactgcctggatgcagcgaaggcctgcaacctcgacgacatttgcaagaagtacaggtcggcgtacatcaccccgtgcaccaccagcgtgtccaacgatgtctgcaaccgccgcaagtgccacaaggccctccggcagttctttgacaaggtcccggccaagcacagctacggaatgctcttctgctcctgccgggacatcgcctgcacagagcggaggcgacagaccatcgtgcctgtgtgctcctatgaagagagggagaagcccaactgtttgaatttgcaggactcctgcaagacgaattacatctgcagatctcgccttgcggatttttttaccaactgccagccagagtcaaggtctgtcagcagctgtctaaaggaaaactacgctgactgcctcctcgcctactcggggcttattggcacagtcatgacccccaactacatagactccagtagcctcagtgtggccccatggtgtgactgcagcaacagtgggaacgacctagaagagtgcttgaaatttttgaatttcttcaaggacaatacatgtcttaaaaatgcaattcaagcctttggcaatggctccgatgtgaccgtgtggcagccagccttcccagtacagaccaccactgccactaccaccactgccctccgggttaagaacaagcccctggggccagcagggtctgagaatgaaattcccactcatgttttgccaccgtgtgcaaatttacaggcacagaagctgaaatccaatgtgtcgggcaatacacacctctgtatttccaatggtaattatgaaaaagaaggtctcggtgcttccagccacataaccacaaaatcaatggctgctcctccaagctgtggtctgagcccactgctggtcctggtggtaaccgctctgtccaccctattatctttaacagaaacatcatagctgcattaaaaaaatacaatatggacatgtaaaaagacaaaaaccaagttatctgtttcctgttctcttgtatagctgaaattccagtttaggagctcagttgagaaacagttccattcaactggaacattttttttttttccttttaagaaagcttcttgtgatcctttggggcttctgtgaaaaacctgatgcagtgctccatccaaactcagaaggctttgggatatgctgtattttaaagggacagtttgtaacttgggctgtaaagcaaactggggctgtgttttcgatgatgatgatgatcatgatgatgatgattttaacagttttacttctggcctttcctagctagagaaggagttaatatttctaaggtaactcccatatctcctttaatgacattgatttctaatgatataaatttcagcctacattgatgccaagcttttttgccacaaagaagattcttaccaagagtgggctttgtggaaacagctggtactgatgttcacctttatatatgtactagcattttccacgctgatgtttatgtactgtaaacagttctgcactcttgtacaaaagaaaaaacacctgtcacatccaaatatagtatctgtcttttcgtcaaaatagagagtggggaatgagtgtgccgattcaatacctcaatccctgaacgacactctcctaatcctaagccttacctgagtgagaagccctttacctaacaaaagtccaatatagctgaaatgtcgctctaatactctttacacatatgaggttatatgtagaaaaaaattttactactaaatgatttcaactattggctttctatattttgaaagtaatgatattgtctcatttttttactgatggtttaatacaaaatacacagagcttctttcccctcataagtagtgttcgctctgatatgaacttcacaaatacagctcatcaaaagcagactctgagaagcctcgtgctgtagcagaaagttctgcatcatgtgactgtggacaggcaggaggaaacagaacagacaagcattgtcttttgtcattgctcgaagtgcaagcgtgcatacctgtggagggaactggtggctgcttgtaaatgttctgcagcatctcttgacacacttgtcatgacacaatccagtaccttggttttcaggttatctgacaaaggcagctttgattgggacatggaggcatgggcaggttctcctttctttggaaacacatccatgctgggatgcacagttcttttcctaaggattgtgtttactcctgactgcaa

SEQ ID NO: 6 - DNA, 3396 bp, Homo sapiens
cagaacactgcgtgtcctgtgcgcgcgtacgggtccggccgcgggtcccaccgcaagcgggcgtgtgcagctgcggctgcctggcgggcgagcttaggagggagctggagctgcggagcggcgggaacaggagcaggccgagggtcctctggccagaagaaatctggcctcggaacacgccattctccgcgccgcttccaataaccactaacatccctaacgagcatccgagccgagggctctgctcggaaatcgtcctggcccaactcggcccttcgagctctcgaagattaccgcatctattttttttttcttttttttcttttcctagcgcagataaagtgagcccggaaagggaaggagggggcggggacaccattgccctgaaagaataaataagtaaataaacaaactggctcctcgccgcagctggacgcggtcggttgagtccaggttgggtcggacctgaacccctaaaagcggaaccgcctcccgccctcgccatcccggagctgagtcgccggcggcggtggctgctgccagacccggagtttcctctttcactggatggagctgaactttgggcggccagagcagcacagctgtccggggatcgctgcatgctgagctccctcggcaagacccagcggcggctcgggatttttttgggggggcggggaccagccccgcgccggcaccatgttcctggcgaccctgtacttcgcgctgccgctcttggacttgctcctgtcggccgaagtgagcggcggagaccgcctggattgcgtgaaagccagtgatcagtgcctgaaggagcagagctgcagcaccaagtaccgcacgctaaggcagtgcgtggcgggcaaggagaccaacttcagcctggcatccggcctggaggccaaggatgagtgccgcagcgccatggaggccctgaagcagaagtcgctctacaactgccgctgcaagcggggtatgaagaaggagaagaactgcctgcgcatttactggagcatgtaccagagcctgcagggaaatgatctgctggaggattccccatatgaaccagttaacagcagattgtcagatatattccgggtggtcccattcatatcagttgcagtggagcacattcccaaagggaacaactgcctggatgcagcgaaggcctgcaacctcgacgacatttgcaagaagtacaggtcggcgtacatcaccccgtgcaccaccagcgtgtccaacgatgtctgcaaccgccgcaagtgccacaaggccctccggcagttctttgacaaggtcccggccaagcacagctacggaatgctcttctgctcctgccgggacatcgcctgcacagagcggaggcgacagaccatcgtgcctgtgtgctcctatgaagagagggagaagcccaactgtttgaatttgcaggactcctgcaagacgaattacatctgcagatctcgccttgcggatttttttaccaactgccagccagagtcaaggtctgtcagcagctgtctaaaggaaaactacgctgactgcctcctcgcctactcggggcttattggcacagtcatgacccccaactacatagactccagtagcctcagtgtggccccatggtgtgactgcagcaacagtgggaacgacctagaagagtgcttgaaatttttgaatttcttcaaggacaatacatgtcttaaaaatgcaattcaagcctttggcaatggctccgatgtgaccgtgtggcagccagccttcccagtacagaccaccactgccactaccaccactgccctccgggttaagaacaagcccctggggccagcagggtctgagaatgaaattcccactcatgttttgccaccgtgtgcaaatttacaggcacagaagctgaaatccaatgtgtcgggcaatacacacctctgtatttccaatggtaattatgaaaaagaaggtctcggtgcttccagccacataaccacaaaatcaatggctgctcctccaagctgtggtctgagcccactgctggtcctggtggtaaccgctctgtccaccctattatctttaacagaaacatcatagctgcattaaaaaaatacaatatggacatgtaaaaagacaaaaaccaagttatctgtttcctgttctcttgtatagctgaaattccagtttaggagctcagttgagaaacagttccattcaactggaacattttttttttttccttttaagaaagcttcttgtgatcctttggggcttctgtgaaaaacctgatgcagtgctccatccaaactcagaaggctttgggatatgctgtattttaaagggacagtttgtaacttgggctgtaaagcaaactggggctgtgttttcgatgatgatgatgatcatgatcatgatgatgattttaacagttttacttctggcctttcctagctagagaaggagttaatatttctaaggtaactcccatatctcctttaatgacattgatttctaatgatataaatttcagcctacattgatgccaagcttttttgccacaaagaagattcttaccaagagtgggctttgtggaaacagctggtactgatgttcacctttatatatgtactagcattttccacgctgatgtttatgtactgtaaacagttctgcactcttgtacaaaagaaaaaacacctgtcacatccaaatatagtatctgtcttttcgtcaaaatagagagtggggaatgagtgtgccgattcaatacctcaatccctgaacgacactctcctaatcctaagccttacctgagtgagaagccctttacctaacaaaagtccaatatagctgaaatgtcgctctaatactctttacacatatgaggttatatgtagaaaaaaattttactactaaatgatttcaactattggctttctatattttgaaagtaatgatattgtctcatttttttactgatggtttaatacaaaatacacagagcttctttcccctcataagtagtgttcgctctgatatgaacttcacaaatacagctcatcaaaagcagactctgagaagcctcgtgctgtagcagaaagttctgcatcatgtgactgtggacaggcaggaggaaacagaacagacaagcattgtcttttgtcattgctcgaagtgcaagcgtgcatacctgtggagggaactggtggctgcttgtaaatgttctgcagcatctcttgacacacttgtcatgacacaatccagtaccttggttttcaggttatctgacaaaggcagctttgattgggacatggaggcatgggcaggttctcctttctttggaaacacatccatgctgggatgcacagttcttttcctaaggattgtgtttactcctgactgcaa

SEQ ID NO: 7 - DNA, 3396 bp, Homo sapiens; identical to SEQ ID NO: 6

SEQ ID NO: 8 - DNA, 3396 bp, Homo sapiens; identical to SEQ ID NO: 6

SEQ ID NO: 9 - protein, 209 aa, Homo sapiens
MASMGLQVMGIALAVLGWLAVMLCCALPMWRVTAFIGSNIVTSQTIWEGLWMNCVVQSTGQMQCKVYDSLLALPQDLQAARALVIISIIVAALGVLLSVVGGKCTNCLEDESAKAKTMIVAGVVFLLAGLMVIVPVSWTAHNIIQDFYNPLVASGQKREMGASLYVGWAASGLLLLGGGLLCCNCPPRTDKPYSAKYSAARSAAASNYV

SEQ ID NO: 10 - DNA, 1830 bp, Homo sapiens
tcaaaagtgcctttgttggcctgggctcaggaatccagagaaactggtcaggaggaggccccagtgacaaaaacccctccctctgcccccgcccctctgccagagccatataactgctcaacctgtccccgagagagagtgccctggcagctgtcggctggaaggaactggtctgctcacacttgctggcttgcgcatcaggactggctttatctcctgactcacggtgcaaaggtgcactctgcgaacgttaagtccgtccccagcgcttggaatcctacggcccccacagccggatcccctcagccttccaggtcctcaactcccgcggacgctgaacaatggcctccatggggctacaggtaatgggcatcgcgctggccgtcctgggctggctggccgtcatgctgtgctgcgcgctgcccatgtggcgcgtgacggccttcatcggcagcaacattgtcacctcgcagaccatctgggagggcctatggatgaactgcgtggtgcagagcaccggccagatgcagtgcaaggtgtacgactcgctgctggcactgccgcaggacctgcaggcggcccgcgccctcgtcatcatcagcatcatcgtggctgctctgggcgtgctgctgtccgtggtggggggcaagtgtaccaactgcctggaggatgaaagcgccaaggccaagaccatgatcgtggcgggcgtggtgttcctgttggccggccttatggtgatagtgccggtgtcctggacggcccacaacatcatccaagacttctacaatccgctggtggcctccgggcagaagcgggagatgggtgcctcgctctacgtcggctgggccgcctccggcctgctgctccttggcggggggctgctttgctgcaactgtccaccccgcacagacaagccttactccgccaagtattctgctgcccgctctgctgctgccagcaactacgtgtaaggtgccacggctccactctgttcctctctgctttgttcttccctggactgagctcagcgcaggctgtgaccccaggagggccctgccacgggccactggctgctggggactggggactgggcagagactgagccaggcaggaaggcagcagccttcagcctctctggcccactcggacaacttcccaaggccgcctcctgctagcaagaacagagtccaccctcctctggatattggggagggacggaagtgacagggtgtggtggtggagtggggagctggcttctgctggccaggatagcttaaccctgactttgggatctgcctgcatcggcgttggccactgtccccatttacattttccccactctgtctgcctgcatctcctctgttccgggtaggccttgatatcacctctgggactgtgccttgctcaccgaaacccgcgcccaggagtatggctgaggccttgcccacccacctgcctgggaagtgcagagtggatggacgggtttagaggggaggggcgaaggtgctgtaaacaggtttgggcagtggtgggggagggggccagagaggcggctcaggttgcccagctctgtggcctcaggactctctgcctcacccgcttcagcccagggcccctggagactgatcccctctgagtcctctgccccttccaaggacactaatgagcctgggagggtggcagggaggaggggacagcttcacccttggaagtcctggggtttttcctcttccttctttgtggtttctgttttgtaatttaagaagagctattcatcactgtaattattattattttctacaataaatgggacctgtgcacaggaggaaa

SEQ ID NO: 11 - protein, 349 aa, Homo sapiens
PSNLVSAAFRSYSTTYEERNITGTRVKVPVGQEVEGMNILGLVVFAIVFGVALRKLGPEGELLIRFFNSFNEATMVLVSWIMWYAPVGIMFLVAGKIVEMEDVGLLFARLGKYILCCLLGHAIHGLLVLPLIYFLFTRKNPYRFLWGIVTPLATAFGTSSSSATLPLMMKCVEENNGVAKHISRFILPIGATVNMDGAALFQCVAAVFIAQLSQQSLDFVKIITILVTATASSVGAAGIPAGGVLTLAIILEAVNLPVDHISLILAVDWLVDRSCTVLNVEGDALGAGLLQNYVDRTESRSTEPELIQVKSELPLDPLPLPTEEGNPLLKHYRGPAGDATVASEKESVM

SEQ ID NO: 12 - protein, 541 aa, Homo sapiens
MVADPPRDSKGLAAAEPTANGGLALASIEDQGAAAGGYCGSRDQVRRCLRANLLVLLTVVAVVAGVALGLGVSGAGGALALGPERLSAFVFPGELLLRLLRMIILPLVVCSLIGGAASLDPGALGRLGAWALLFFLVTTLLASALGVGLALALQPGAASAAINASVGAAGSAENAPSKEVLDSFLDLARNIFPSNLVSAAFRSYSTTYEERNITGTRVKVPVGQEVEGMNILGLVVFAIVFGVALRKLGPEGELLIRFFNSFNEATMVLVSWIMWYAPVGIMFLVAGKIVEMEDVGLLFARLGKYILCCLLGHAIHGLLVLPLIYFLFTRKNPYRFLWGIVTPLATAFGTSSSSATLPLMMKCVEENNGVAKHISRFILPIGATVNMDGAALFQCVAAVFIAQLSQQSLDFVKIITILVTATASSVGAAGIPAGGVLTLAIILEAVNLPVDHISLILAVDWLVDRSCTVLNVEGDALGAGLLQNYVDRTESRSTEPELIQVKSELPLDPLPVPTEEGNPLLKHYRGPAGDATVASEKESVM

SEQ ID NO: 13 - DNA, 3327 bp, Homo sapiens
aacacctgcactttatattcgaggaattaaagttctcagaggcgactaaagaccaaactcagggctgaggagttccaaagctgagttgagttgcaaatgaatcaccgaggaccaccggagctttctagcgaccctcgcaccagggaacgaacccctgtggtttaagggctccaacccacaacccagttcctttggcgggaaacagcaccctcccaaggccccgccccttcctggccccgccccgtcgtctctgggcccggctcctggagatgggtattattaatctgccttctatgggggacctggcccatctcgggtatcagccccgcccctactcgtccagtctccgaacgctctgcagccaatcggcgcccgagggtcggtccccgccttctcaagccccgccccctacccttatccctggcagcttccgctaaacgggctcagagccacgcggcacgcccgggaggctttctctggctggtaaccgctactcccggacaccagaccaccgccttccgtacacaggggcccgcatcccaccctcccggacctaagagcctgggtcccctgtttccggaggtccgcttcccggcccccagattctggcatcccagccctcagtgtccaagacccaggcagcccgggtccccgcctcccggatccaggcgtccgggatctgcgccaccagaacctagcctcctgcagacctccgccatctgggggcactcaacctcctggagccaagggccccacgtcccacccagagaaactctcgtattcccagctcctagggccaaggaacccgggcgctccgaactcccagctttcggacatctggcacacggggcagagcagagaagcctcagcgcccagcctggggaatttaaacactccagcttccaagagccaaggaacttcagtgctgtgaactcacaactctaaggagccctccaaagttccagtctccaggtgctgttactcaactcagtcctaggaacgtcgggtcctgggaaggagcccaagcgctcccagccagcttccaggcgctaagaaaccccggtgcttcccatcatggtggccgatcctcctcgagactccaaggggctcgcagcggcggagcccaccgccaacgggggcctggcgctggcctccatcgaggaccaaggcgcggcagcaggcggctactgcggttcccgggaccaggtgcgccgctgccttcgagccaacctgcttgtgctgctgacagtggtggccgtggtggccggcgtggcgctgggactgggggtgtcgggggccgggggtgcgctggcgttgggcccggagcgcttgagcgccttcgtcttcccgggcgagctgctgctgcgtctgctgcggatgatcatcttgccgctggtggtgtgcagcttgatcggcggcgccgccagcctggaccccggcgcgctcggccgtctgggcgcctgggcgctgctctttttcctggtcaccacgctgctggcgtcggcgctcggagtgggcttggcgctggctctgcagccgggcgccgcctccgccgccatcaacgcctccgtgggagccgcgggcagtgccgaaaatgcccccagcaaggaggtgctcgattcgttcctggatcttgcgagaaatatcttcccttccaacctggtgtcagcagcctttcgctcatactctaccacctatgaagagaggaatatcaccggaaccagggtgaaggtgcccgtggggcaggaggtggaggggatgaacatcctgggcttggtagtgtttgccatcgtctttggtgtggcgctgcggaagctggggcctgaaggggagctgcttatccgcttcttcaactccttcaatgaggccaccatggttctggtctcctggatcatgtggtacgcccctgtgggcatcatgttcctggtggctggcaagatcgtggagatggaggatgtgggtttactctttgcccgccttggcaagtacattctgtgctgcctgctgggtcacgccatccatgggctcctggtactgcccctcatctacttcctcttcacccgcaaaaacccctaccgcttcctgtggggcatcgtgacgccgctggccactgcctttgggacctcttccagttccgccacgctgccgctgatgatgaagtgcgtggaggagaataatggcgtggccaagcacatcagccgtttcatcctgcccatcggcgccaccgtcaacatggacggtgccgcgctcttccagtgcgtggccgcagtgttcattgcacagctcagccagcagtccttggacttcgtaaagatcatcaccatcctggtcacggccacagcgtccagcgtgggggcagcgggcatccctgctggaggtgtcctcactctggccatcatcctcgaagcagtcaacctcccggtcgaccatatctccttgatcctggctgtggactggctagtcgaccggtcctgtaccgtcctcaatgtagaaggtgacgctctgggggcaggactcctccaaaattacgtggaccgtacggagtcgagaagcacagagcctgagttgatacaagtgaagagtgagctgcccctggatccgctgccagtccccactgaggaaggaaaccccctcctcaaacactatcgggggcccgcaggggatgccacggtcgcctctgagaaggaatcagtcatgtaaaccccgggagggaccttccctgccctgctgggggtgctctttggacactggattatgaggaatggataaatggatgagctagggctctgggggtctgcctgcacactctggggagccaggggccccagcaccctccaggacaggagatctgggatgcctggctgctggagtacatgtgttcacaagggttactcctcaaaacccccagttctcactcatgtccccaactcaaggctagaaaacagcaagatggagaaataatgttctgctgcgtccccaccgtgacctgcctggcctcccctgtctcagggagcaggtcacaggtcaccatggggaattctagcccccactggggggatgttacaacaccatgctggttattttggcggctgtagttgtggggggatgtgtgtgtgcacgtgtgtgtgtgtgtgtgtgtgtgtgtgtgtgtgtgtgttctgtgacctcctgtccccatggtacgtcccaccctgtccccagatcccctattccctccacaataacagaaacactcccagggactctggggagaggctgaggacaaatacctgctgtcactccagaggacattttttttagcaataaaattgagtgtcaactatttaa

SEQ ID NO: 14 - DNA, 3327 bp, Homo sapiens; identical to SEQ ID NO: 13

SEQ ID NO: 15 - DNA, 2476 bp, Homo sapiens
ggcccgcatcccaccctcccggacctaagagcctgggtcccctgtttccggaggtccgcttcccggcccccagattctggcatcccagccctcagtgtccacaaggaacccgggcgctccgaactcccagctttcggacatctggcacacggggcagagcagagaagcctcagcgcccagcctggggaatttaaacactccagcttccaagagccaaggaacttcagtgctgtgaactcacaactctaaggagccctccaaagttccagtctccaggtgctgttactcaactcagtcctaggaacgtcgggtcctgggaaggagcccaagcgctcccagccagcttccaggcgctaagaaaccccggtgcttcccatcatggtggccgatcctcctcgagactccaaggggctcgcagcggcggagcccaccgccaacgggggcctggcgctggcctccatcgaggaccaaggcgcggcagcaggcggctactgcggttcccgggaccaggtgcgccgctgccttcgagccaacctgcttgtgctgctgacagtggtggccgtggtggccggcgtggcgctgggactgggggtgtcgggggccgggggtgcgctggcgttgggcccggagcgcttgagcgccttcgtcttcccgggcgagctgctgctgcgtctgctgcggatgatcatcttgccgctggtggtgtgcagcttgatcggcggcgccgccagcctggaccccggcgcgctcggccgtctgggcgcctgggcgctgctctttttcctggtcaccacgctgctggcgtcggcgctcggagtgggcttggcgctggctctgcagccgggcgccgcctccgccgccatcaacgcctccgtgggagccgcgggcagtgccgaaaatgcccccagcaaggaggtgctcgattcgttcctggatcttgcgagaaatatcttcccttccaacctggtgtcagcagcctttcgctcatactctaccacctatgaagagaggaatatcaccggaaccagggtgaaggtgcccgtggggcaggaggtggaggggatgaacatcctgggcttggtagtgtttgccatcgtctttggtgtggcgctgcggaagctggggcctgaaggggagctgcttatccgcttcttcaactccttcaatgaggccaccatggttctggtctcctggatcatgtggtacgcccctgtgggcatcatgttcctggtggctggcaagatcgtggagatggaggatgtgggtttactctttgcccgccttggcaagtacattctgtgctgcctgctgggtcacgccatccatgggctcctggtactgcccctcatctacttcctcttcacccgcaaaaacccctaccgcttcctgtggggcatcgtgacgccgctggccactgcctttgggacctcttccagttccgccacgctgccgctgatgatgaagtgcgtggaggagaataatggcgtggccaagcacatcagccgtttcatcctgcccatcggcgccaccgtcaacatggacggtgccgcgctcttccagtgcgtggccgcagtgttcattgcacagctcagccagcagtccttggacttcgtaaagatcatcaccatcctggtcacggccacagcgtccagcgtgggggcagcgggcatccctgctggaggtgtcctcactctggccatcatcctcgaagcagtcaacctcccggtcgaccatatctccttgatcctggctgtggactggctagtcgaccggtcctgtaccgtcctcaatgtagaaggtgacgctctgggggcaggactcctccaaaattacgtggaccgtacggagtcgagaagcacagagcctgagttgatacaagtgaagagtgagctgcccctggatccgctgccagtccccactgaggaaggaaaccccctcctcaaacactatcgggggcccgcaggggatgccacggtcgcctctgagaaggaatcagtcatgtaaaccccgggagggaccttccctgccctgctgggggtgctctttggacactggattatgaggaatggataaatggatgagctagggctctgggggtctgcctgcacactctggggagccaggggccccagcaccctccaggacaggagatctgggatgcctggctgctggagtacatgtgttcacaagggttactcctcaaaacccccagttctcactcatgtccccaactcaaggctagaaaacagcaagatggagaaataatgttctgctgcgtccccaccgtgacctgcctggcctcccctgtctcagggagcaggtcacaggtcaccatggggaattctagcccccactggggggatgttacaacaccatgctggttattttggcggctgtagttgtggggggatgtgtgtgtgcacgtgtgtgtgtgtgtgtgtgtgttgttctgtgacctcctgtccccatggtacgt

SEQ ID NO: 16 - protein, 570 aa, Homo sapiens [sequence omitted]

SEQ ID NO: 17 - protein, 532 aa, Homo sapiens [sequence omitted]

SEQ ID NO: 18 - protein, 583 aa, Homo sapiens
MESKGASSCRLLFCLLISATVFRPGLGWYTVNSAYGDTIIIPCRLDVPQNLMFGKWKYEKPDGSPVFIAFRSSTKKSVQYDDVPEYKDRLNLSENYTLSISNARISDEKRFVCMLVTEDNVFEAPTIVKVFKQPSKPEIVSKALFLETEQLKKLGDCISEDSYPDGNITWYRNGKVLHPLEGAVVIIFKKEMDPVTQLYTMTSTLEYKTTKADIQMPFTCSVTYYGPSGQKTIHSEQAVFDIYYPTEQVTIQVLPPKNAIKEGDNITLKCLGNGNPPPEEFLFYLPGQPEGIRSSNTYTLMDVRRNATGDYKCSLIDKKSMIASTAITVHYLDLSLNPSGEVTRQIGDALPVSCTISASRNATVVWMKDNIRLRSSPSFSSLHYQDAGNYVCETALQEVEGLKKRESLTLIVEGKPQIKMTKKTDPSGLSKTIICHVEGFPKPAIQWTITGSGSVINQTEESPYINGRYYSKIIISPEENVTLTCTAENQLERTVNSLNVSAISIPEHDEADEISDENREKVNDQAKLIVGIVVGLLLAALVAGVVYWLYMKKSKTASKHVNKDLGNMEENKKLEENNHKTEA

SEQ ID NO: 19 - protein, 583 aa, Homo sapiens [sequence omitted]

SEQ ID NO: 20 - DNA, 4859 bp, Homo sapiens
acgcggttctccctgatcccggagctgggctcagggctcggactcagtcctgcagcgcctctaggctgcggatccgcgcttcaaccacctgctttgcgctgcgtccggggaagtggggaggagacgggagggagggaggaggcggggagaggaggaaagaggcagcttacacacgccttccagtccctctactcagagcagcccggagaccgctgccgccgctgccgctgctaccaccgctgccacctgaggagacccgccgcccccccgtcgccgcctcctgcgagtccttcttagcacctggcgtttcatgcacattgccactgccattattattatcattccaatacaaggaaaataaaagaagataccagcgaaaagaaccgcttacacctttccgaattactcaagtgtctcctggaaacagagggtcgttgtccccggaggagcagccgaagggcccgtgggctggtgttgaccgggagggaggaggagttgggggcattgcgtggtggaaagttgcgtgcggcagagaaccgaaggtgcagcgccacagcccaggggacggtgtgtctgggagaagacgctgcccctgcgtcgggacccgccagcgcgcgggcaccgcggggcccgggacgacgccccctcctgcggcgtggactccgtcagtggcccaccaagaaggaggaggaatatggaatccaagggggccagttcctgccgtctgctcttctgcctcttgatctccgccaccgtcttcaggccaggccttggatggtatactgtaaattcagcatatggagataccattatcataccttgccgacttgacgtacctcagaatctcatgtttggcaaatggaaatatgaaaagcccgatggctccccagtatttattgccttcagatcctctacaaagaaaagtgtgcagtacgacgatgtaccagaatacaaagacagattgaacctctcagaaaactacactttgtctatcagtaatgcaaggatcagtgatgaaaagagatttgtgtgcatgctagtaactgaggacaacgtgtttgaggcacctacaatagtcaaggtgttcaagcaaccatctaaacctgaaattgtaagcaaagcactgtttctcgaaacagagcagctaaaaaagttgggtgactgcatttcagaagacagttatccagatggcaatatcacatggtacaggaatggaaaagtgctacatccccttgaaggagcggtggtcataatttttaaaaaggaaatggacccagtgactcagctctataccatgacttccaccctggagtacaagacaaccaaggctgacatacaaatgccattcacctgctcggtgacatattatggaccatctggccagaaaacaattcattctgaacaggcagtatttgatatttactatcctacagagcaggtgacaatacaagtgctgccaccaaaaaatgccatcaaagaaggggataacatcactcttaaatgcttagggaatggcaaccctcccccagaggaatttttgttttacttaccaggacagcccgaaggaataagaagctcaaatacttacacactaacggatgtgaggcgcaatgcaacaggagactacaagtgttccctgatagacaaaaaaagcatgattgcttcaacagccatcacagttcactatttggatttgtccttaaacccaagtggagaagtgactagacagattggtgatgccctacccgtgtcatgcacaatatctgctagcaggaatgcaactgtggtatggatgaaagataacatcaggcttcgatctagcccgtcattttctagtcttcattatcaggatgctggaaactatgtctgcgaaactgctctgcaggaggttgaaggactaaagaaaagagagtcattgactctcattgtagaaggcaaacctcaaataaaaatgacaaagaaaactgatcccagtggactatctaaaacaataatctgccatgtggaaggttttccaaagccagccattcaatggacaattactggcagtggaagcgtcataaaccaagcaaaggaatctccttatattaatggcaggtattatagtaaaattatcatttcccctgaagagaatgttacattaacttgcacagcagaaaaccaactggagagaacagtaaactccttgaatgtctctgctaatgaaaacagagaaaaggtgaatgaccaggcaaaactaattgtgggaatcgttgttggtctcctccttgctgcccttgttgctggtgtcgtctactggctgtacatgaagaagtcaaagactgcatcaaaacatgtaaacaaggacctcggtaatatggaagaaaacaaaaagttagaagaaaacaatcacaaaactgaagcctaagagagaaactgtcctagttgtccagagataaaaatcatatagaccaattgaagcatgaacgtggattgtatttaagacataaacaaagacattgacagcaattcatggttcaagtattaagcagttcattctaccaagctgtcacaggttttcagagaattatctcaagtaaaacaaatgaaatttaattacaaacaataagaacaagttttggcagccatgataataggtcatatgttgtgtttggttcaattttttttccgtaaatgtctgcactgaggatttctttttggtttgccttttatgtaaattttttacgtagctatttttatacactgtaagctttgttctgggagttgctgttaatctgatgtataatgtaatgtttttatttcaattgtttatatggataatctgagcaggtacatttctgattctgattgctatcagcaatgccccaaactttctcataagcacctaaaacccaaaggtggcagcttgtgaagattggggacactcatattgccctaattaaaaactgtgatttttatcacaagggaggggaggccgagagtcagactgatagacaccataggagccgactctttgatatgccaccagcgaactctcagaaataaatcacagatgcatatagacacacatacataatggtactcccaaactgacaattttacctattctgaaaaagacataaaacagaatttggtagcacttacctctacagacacctgctaataaattattttctgtcaaaagaaaaaacacaagcatgtgtgagagacagtttggaaaaatcatggtcaacattcccattttcatagatcacaatgtaaatcactataattacaaattggtgttaaatcctttgggttatccactgccttaaaattatacctatttcatgtttaaaaagatatcaatcagaattggagtttttaacagtggtcattatcaaagctgtgttattttccacagaatatagaatatatatttttttcgtgtgtgtttttgttaactaccctacagatattgaatgcaccttgagataatttagtgtttttaactgatacataatttatcaagcagtacatgaaagtgtaataataaaatgtctatgtatctttagttacattcaaatttgtaactttataaacatgttttatgcttgaggaaatttttaaggtggtagtataaatggaaactttttgaagtagaccagatatgggctacttgtgactagacttttaaactttgctctttcaagcagaagcctggtttctgggagaacactgcacagcgatttctttcccaggatttacacaactttaaagggaagataaatgaacatcagatttctaggtatagaactatgttattgaaaggaaaaggaaaactggtgtttgtttcttagactcatgaaataaaaaattatgaaggcaatgaaaaataaattgaaaattaaagtcagatgagaataggaataatactttgccacttctgcattatttagaaacatacgttattgtacatttgtaaaccatttactgtctgggcaatagtgactccgtttaataaaagcttccgtagtgcattggtatggattaaatgcataaaatattcttagactcgatgctgtataaaatattatgggaaaaaaagaaaatacgttattttgcctctaaacttttattgaagttttatttggcaggaaaaaaaattgaatcttggtcaacatttaaaccaaagtaaaaggggaaaaaccaaagttatttgttttgcatggctaagccattctgttatctctgtaaatactgtgatttcttttttattttctctttagaattttgttaaagaaattctaaaatttttaaacacctgctctccacaataaatcacaaacactaaaataaaattacttccatataaatattattttctcttttggtgtgggagatcaaaggtttaaagtctaacttctaagatatatttgcagaaagaagcaacatgacaatagagagagttatgctacaattatttcttggtttccacttgcaatggttaattaagtccaaaaacagctgtcagaacctcgagagcagaacatgagaaactcagagctctggaccgaaagcagaaagtttgccgggaaaaaaaaagacaacattattaccatcgattcagtgcctggataaagaggaaagcttacttgtttaatggcagccacatgcacgaagatgctaagaagaaaaagaattccaaatcctcaacttttgaggtttcggctctccaatttaactctttggcaacaggaaacaggttttgcaagttcaaggttcactccctatatgtgattataggaattgtttgtggaaatggattaacatacccgtctatgcctaaaagataataaaactgaaatatgtcttcacag

SEQ ID NO: 21 - DNA, 4177 bp, Homo sapiens
gttctctctctctttctctcttcttccttttttttttcccccaaaggccttggatggtatactgtaaattcagcatatggagataccattatcataccttgccgacttgacgtacctcagaatctcatgtttggcaaatggaaatatgaaaagcccgatggctccccagtatttattgccttcagatcctctacaaagaaaagtgtgcagtacgacgatgtaccagaatacaaagacagattgaacctctcagaaaactacactttgtctatcagtaatgcaaggatcagtgatgaaaagagatttgtgtgcatgctagtaactgaggacaacgtgtttgaggcacctacaatagtcaaggtgttcaagcaaccatctaaacctgaaattgtaagcaaagcactgtttctcgaaacagagcagctaaaaaagttgggtgactgcatttcagaagacagttatccagatggcaatatcacatggtacaggaatggaaaagtgctacatccccttgaaggagcggtggtcataatttttaaaaaggaaatggacccagtgactcagctctataccatgacttccaccctggagtacaagacaaccaaggctgacatacaaatgccattcacctgctcggtgacatattatggaccatctggccagaaaacaattcattctgaacaggcagtatttgatatttactatcctacagagcaggtgacaatacaagtgctgccaccaaaaaatgccatcaaagaaggggataacatcactcttaaatgcttagggaatggcaaccctcccccagaggaatttttgttttacttaccaggacagcccgaaggaataagaagctcaaatacttacacactaacggatgtgaggcgcaatgcaacaggagactacaagtgttccctgatagacaaaaaaagcatgattgcttcaacagccatcacagttcactatttggatttgtccttaaacccaagtggagaagtgactagacagattggtgatgccctacccgtgtcatgcacaatatctgctagcaggaatgcaactgtggtatggatgaaagataacatcaggcttcgatctagcccgtcattttctagtcttcattatcaggatgctggaaactatgtctgcgaaactgctctgcaggaggttgaaggactaaagaaaagagagtcattgactctcattgtagaaggcaaacctcaaataaaaatgacaaagaaaactgatcccagtggactatctaaaacaataatctgccatgtggaaggttttccaaagccagccattcaatggacaattactggcagtggaagcgtcataaaccaagcaaaggaatctccttatattaatggcaggtattatagtaaaattatcatttcccctgaagagaatgttacattaacttgcacagcagaaaaccaactggagagaacagtaaactccttgaatgtctctgctataagtattccagaacacgatgaggcagacgagataagtgatgaaaacagagaaaaggtgaatgaccaggcaaaactaattgtgggaatcgttgttggtctcctccttgctgcccttgttgctggtgtcgtctactggctgtacatgaagaagtcaaagactgcatcaaaacatgtaaacaaggacctcggtaatatggaagaaaacaaaaagttagaagaaaacaatcacaaaactgaagcctaagagagaaactgtcctagttgtccagagataaaaatcatatagaccaattgaagcatgaacgtggattgtatttaagacataaacaaagacattgacagcaattcatggttcaagtattaagcagttcattctaccaagctgtcacaggttttcagagaattatctcaagtaaaacaaatgaaatttaattacaaacaataagaacaagttttggcagccatgataataggtcatatgttgtgtttggttcaattttttttccgtaaatgtctgcactgaggatttctttttggtttgccttttatgtaaattttttacgtagctatttttatacactgtaagctttgttctgggagttgctgttaatctgatgtataatgtaatgtttttatttcaattgtttatatggataatctgagcaggtacatttctgattctgattgctatcagcaatgccccaaactttctcataagcacctaaaacccaaaggtggcagcttgtgaagattggggacactcatattgccctaattaaaaactgtgatttttatcacaagggaggggaggccgagagtcagactgatagacaccataggagccgactctttgatatgccaccagcgaactctcagaaataaatcacagatgcatatagacacacatacataatggtactcccaaactgacaattttacctattctgaaaaagacataaaacagaatttggtagcacttacctctacagacacctgctaataaattattttctgtcaaaagaaaaaacacaagcatgtgtgagagacagtttggaaaaatcatggtcaacattcccattttcatagatcacaatgtaaatcactataattacaaattggtgttaaatcctttgggttatccactgccttaaaattatacctatttcatgtttaaaaagatatcaatcagaattggagtttttaacagtggtcattatcaaagctgtgttattttccacagaatatagaatatatatttttttcgtgtgtgtttttgttaactaccctacagatattgaatgcaccttgagataatttagtgtttttaactgatacataatttatcaagcagtacatgaaagtgtaataataaaatgtctatgtatctttagttacattcaaatttgtaactttataaacatgttttatgcttgaggaaatttttaaggtggtagtataaatggaaactttttgaagtagaccagatatgggctacttgtgactagacttttaaactttgctctttcaagcagaagcctggtttctgggagaacactgcacagcgatttctttcccaggatttacacaactttaaagggaagataaatgaacatcagatttctaggtatagaactatgttattgaaaggaaaaggaaaactggtgtttgtttcttagactcatgaaataaaaaattatgaaggcaatgaaaaataaattgaaaattaaagtcagatgagaataggaataatactttgccacttctgcattatttagaaacatacgttattgtacatttgtaaaccatttactgtctgggcaatagtgactccgtttaataaaagcttccgtagtgcattggtatggattaaatgcataaaatattcttagactcgatgctgtataaaatattatgggaaaaaaagaaaatacgttattttgcctctaaacttttattgaagttttatttggcaggaaaaaaaattgaatcttggtcaacatttaaaccaaagtaaaaggggaaaaaccaaagttatttgttttgcatggctaagccattctgttatctctgtaaatactgtgatttcttttttattttctctttagaattttgttaaagaaattctaaaatttttaaacacctgctctccacaataaatcacaaacactaaaataaaattacttccatataaatattattttctcttttggtgtgggagatcaaaggtttaaagtctaacttctaagatatatttgcagaaagaagcaacatgacaatagagagagttatgctacaattatttcttggtttccacttgcaatggttaattaagtccaaaaacagctgtcagaacctcgagagcagaacatgagaaactcagagctctggaccgaaagcagaaagtttgccgggaaaaaaaaagacaacattattaccatcgattcagtgcctggataaagaggaaagcttacttgtttaatggcagccacatgcacgaagatgctaagaagaaaaagaattccaaatcctcaacttttgaggtttcggctctccaatttaactctttggcaacaggaaacaggttttgcaagttcaaggttcactccctatatgtgattataggaattgtttgtggaaatggattaacatacccgtctatgcctaaaagataataaaactgaaatatgtcttcacag

SEQ ID NO: 22 - DNA, 2539 bp, Homo sapiens
cgggacgacgccccctcctgcggcgtggactccgtcagtggcccaccaagaaggaggaggaatatggaatccaagggggccagttcctgccgtctgctcttctgcctcttgatctccgccaccgtcttcaggccaggccttggatggtatactgtaaattcagcatatggagataccattatcataccttgccgacttgacgtacctcagaatctcatgtttggcaaatggaaatatgaaaagcccgatggctccccagtatttattgccttcagatcctctacaaagaaaagtgtgcagtacgacgatgtaccagaatacaaagacagattgaacctctcagaaaactacactttgtctatcagtaatgcaaggatcagtgatgaaaagagatttgtgtgcatgctagtaactgaggacaacgtgtttgaggcacctacaatagtcaaggtgttcaagcaaccatctaaacctgaaattgtaagcaaagcactgtttctcgaaacagagcagctaaaaaagttgggtgactgcatttcagaagacagttatccagatggcaatatcacatggtacaggaatggaaaagtgctacatccccttgaaggagcggtggtcataatttttaaaaaggaaatggacccagtgactcagctctataccatgacttccaccctggagtacaagacaaccaaggctgacatacaaatgccattcacctgctcggtgacatattatggaccatctggccagaaaacaattcattctgaacaggcagtatttgatatttactatcctacagagcaggtgacaatacaagtgctgccaccaaaaaatgccatcaaagaaggggataacatcactcttaaatgcttagggaatggcaaccctcccccagaggaatttttgttttacttaccaggacagcccgaaggaataagaagctcaaatacttacacactgatggatgtgaggcgcaatgcaacaggagactacaagtgttccctgatagacaaaaaaagcatgattgcttcaacagccatcacagttcactatttggatttgtccttaaacccaagtggagaagtgactagacagattggtgatgccctacccgtgtcatgcacaatatctgctagcaggaatgcaactgtggtatggatgaaagataacatcaggcttcgatctagcccgtcattttctagtcttcattatcaggatgctggaaactatgtctgcgaaactgctctgcaggaggttgaaggactaaagaaaagagagtcattgactctcattgtagaaggcaaacctcaaataaaaatgacaaagaaaactgatcccagtggactatctaaaacaataatctgccatgtggaaggttttccaaagccagccattcagtggacaattactggcagtggaagcgtcataaaccaaacagaggaatctccttatattaatggcaggtattatagtaaaattatcatttcccctgaagagaatgttacattaacttgcacagcagaaaaccaactggagagaacagtaaactccttgaatgtctctgctataagtattccagaacacgatgaggcagacgagataagtgatgaaaacagagaaaaggtgaatgaccaggcaaaactaattgtgggaatcgttgttggtctcctccttgctgcccttgttgctggtgtcgtctactggctgtacatgaagaagtcaaagactgcatcaaaacatgtaaacaaggacctcggtaatatggaagaaaacaaaaagttagaagaaaacaatcacaaaactgaagcctaagagagaaactgtcctagttgtccagagataaaaatcatatagaccaattgaagcatgaacgtggattgtatttaagacataaacaaagacattgacagcaattcatggttcaagtattaagcagttcattctaccaagctgtcacaggttttcagagaattatctcaagtaaaacaaatgaaatttaattacaaacaataagaacaagttttggcagccatgataataggtcatatgttgtgtttggttcaattttttttccgtaaatgtctgcactgaggatttctttttggtttgccttttatgtaaattttttacgtagctatttttatacactgtaagctttgttctgggagttgctgttaatctgatgtataatgtaatgtttttatttcaattgtttatatggataatctgagcaggtacatttctgattctgattgctatcagcaatgccccaaactttctcataagcacctaaaacccaaaggtggcagcttgtgaagattggggacactcatattgccctaattaaaaactgtgatttttatcacaagggaggggaggccgagagtcagactgatagacaccataggagccgactctttgatatgccaccagcgaactctcagaaataaatcacagatgcatatagacacacatacataatggtactcccaaactgacaattttacctattctgaaaaagacataaaacagaatt

SEQ ID NO: 23 - DNA, 4898 bp, Homo sapiens
acgcggttctccctgatcccggagctgggctcagggctcggactcagtcctgcagcgcctctaggctgcggatccgcgcttcaaccacctgctttgcgctgcgtccggggaagtggggaggagacgggagggagggaggaggcggggagaggaggaaagaggcagcttacacacgccttccagtccctctactcagagcagcccggagaccgctgccgccgctgccgctgctaccaccgctgccacctgaggagacccgccgcccccccgtcgccgcctcctgcgagtccttcttagcacctggcgtttcatgcacattgccactgccattattattatcattccaatacaaggaaaataaaagaagataccagcgaaaagaaccgcttacacctttccgaattactcaagtgtctcctggaaacagagggtcgttgtccccggaggagcagccgaagggcccgtgggctggtgttgaccgggagggaggaggagttgggggcattgcgtggtggaaagttgcgtgcggcagagaaccgaaggtgcagcgccacagcccaggggacggtgtgtctgggagaagacgctgcccctgcgtcgggacccgccagcgcgcgggcaccgcggggcccgggacgacgccccctcctgcggcgtggactccgtcagtggcccaccaagaaggaggaggaatatggaatccaagggggccagttcctgccgtctgctcttctgcctcttgatctccgccaccgtcttcaggccaggccttggatggtatactgtaaattcagcatatggagataccattatcataccttgccgacttgacgtacctcagaatctcatgtttggcaaatggaaatatgaaaagcccgatggctccccagtatttattgccttcagatcctctacaaagaaaagtgtgcagtacgacgatgtaccagaatacaaagacagattgaacctctcagaaaactacactttgtctatcagtaatgcaaggatcagtgatgaaaagagatttgtgtgcatgctagtaactgaggacaacgtgtttgaggcacctacaatagtcaaggtgttcaagcaaccatctaaacctgaaattgtaagcaaagcactgtttctcgaaacagagcagctaaaaaagttgggtgactgcatttcagaagacagttatccagatggcaatatcacatggtacaggaatggaaaagtgctacatccccttgaaggagcggtggtcataatttttaaaaaggaaatggacccagtgactcagctctataccatgacttccaccctggagtacaagacaaccaaggctgacatacaaatgccattcacctgctcggtgacatattatggaccatctggccagaaaacaattcattctgaacaggcagtatttgatatttactatcctacagagcaggtgacaatacaagtgctgccaccaaaaaatgccatcaaagaaggggataacatcactcttaaatgcttagggaatggcaaccctcccccagaggaatttttgttttacttaccaggacagcccgaaggaataagaagctcaaatacttacacactaacggatgtgaggcgcaatgcaacaggagactacaagtgttccctgatagacaaaaaaagcatgattgcttcaacagccatcacagttcactatttggatttgtccttaaacccaagtggagaagtgactagacagattggtgatgccctacccgtgtcatgcacaatatctgctagcaggaatgcaactgtggtatggatgaaagataacatcaggcttcgatctagcccgtcattttctagtcttcattatcaggatgctggaaactatgtctgcgaaactgctctgcaggaggttgaaggactaaagaaaagagagtcattgactctcattgtagaaggcaaacctcaaataaaaatgacaaagaaaactgatcccagtggactatctaaaacaataatctgccatgtggaaggttttccaaagccagccattcaatggacaattactggcagtggaagcgtcataaaccaagcaaaggaatctccttatattaatggcaggtattatagtaaaattatcatttcccctgaagagaatgttacattaacttgcacagcagaaaaccaactggagagaacagtaaactccttgaatgtctctgctataagtattccagaacacgatgaggcagacgagataagtgatgaaaacagagaaaaggtgaatgaccaggcaaaactaattgtgggaatcgttgttggtctcctccttgctgcccttgttgctggtgtcgtctactggctgtacatgaagaagtcaaagactgcatcaaaacatgtaaacaaggacctcggtaatatggaagaaaacaaaaagttagaagaaaacaatcacaaaactgaagcctaagagagaaactgtcctagttgtccagagataaaaatcatatagaccaattgaagcatgaacgtggattgtatttaagacataaacaaagacattgacagcaattcatggttcaagtattaagcagttcattctaccaagctgtcacaggttttcagagaattatctcaagtaaaacaaatgaaatttaattacaaacaataagaacaagttttggcagccatgataataggtcatatgttgtgtttggttcaattttttttccgtaaatgtctgcactgaggatttctttttggtttgccttttatgtaaattttttacgtagctatttttatacactgtaagctttgttctgggagttgctgttaatctgatgtataatgtaatgtttttatttcaattgtttatatggataatctgagcaggtacatttctgattctgattgctatcagcaatgccccaaactttctcataagcacctaaaacccaaaggtggcagcttgtgaagattggggacactcatattgccctaattaaaaactgtgatttttatcacaagggaggggaggccgagagtcagactgatagacaccataggagccgactctttgatatgccaccagcgaactctcagaaataaatcacagatgcatatagacacacatacataatggtactcccaaactgacaattttacctattctgaaaaagacataaaacagaatttggtagcacttacctctacagacacctgctaataaattattttctgtcaaaagaaaaaacacaagcatgtgtgagagacagtttggaaaaatcatggtcaacattcccattttcatagatcacaatgtaaatcactataattacaaattggtgttaaatcctttgggttatccactgccttaaaattatacctatttcatgtttaaaaagatatcaatcagaattggagtttttaacagtggtcattatcaaagctgtgttattttccacagaatatagaatatatatttttttcgtgtgtgtttttgttaactaccctacagatattgaatgcaccttgagataatttagtgtttttaactgatacataatttatcaagcagtacatgaaagtgtaataataaaatgtctatgtatctttagttacattcaaatttgtaactttataaacatgttttatgcttgaggaaatttttaaggtggtagtataaatggaaactttttgaagtagaccagatatgggctacttgtgactagacttttaaactttgctctttcaagcagaagcctggtttctgggagaacactgcacagcgatttctttcccaggatttacacaactttaaagggaagataaatgaacatcagatttctaggtatagaactatgttattgaaaggaaaaggaaaactggtgtttgtttcttagactcatgaaataaaaaattatgaaggcaatgaaaaataaattgaaaattaaagtcagatgagaataggaataatactttgccacttctgcattatttagaaacatacgttattgtacatttgtaaaccatttactgtctgggcaatagtgactccgtttaataaaagcttccgtagtgcattggtatggattaaatgcataaaatattcttagactcgatgctgtataaaatattatgggaaaaaaagaaaatacgttattttgcctctaaacttttattgaagttttatttggcaggaaaaaaaattgaatcttggtcaacatttaaaccaaagtaaaaggggaaaaaccaaagttatttgttttgcatggctaagccattctgttatctctgtaaatactgtgatttcttttttattttctctttagaattttgttaaagaaattctaaaatttttaaacacctgctctccacaataaatcacaaacactaaaataaaattacttccatataaatattattttctcttttggtgtgggagatcaaaggtttaaagtctaacttctaagatatatttgcagaaagaagcaacatgacaatagagagagttatgctacaattatttcttggtttccacttgcaatggttaattaagtccaaaaacagctgtcagaacctcgagagcagaacatgagaaactcagagctctggaccgaaagcagaaagtttgccgggaaaaaaaaagacaacattattaccatcgattcagtgcctggataaagaggaaagcttacttgtttaatggcagccacatgcacgaagatgctaagaagaaaaagaattccaaatcctcaacttttgaggtttcggctctccaatttaactctttggcaacaggaaacaggttttgcaagttcaaggttcactccctatatgtgattataggaattgtttgtggaaatggattaacatacccgtctatgcctaaaagataataaaactgaaatatgtcttcacag

SEQ ID NO: 24 - protein, 267 aa, Homo sapiens [sequence omitted]

SEQ ID NO: 25 - protein, 290 aa, Homo sapiens [sequence omitted]

SEQ ID NO: 26 - protein, 193 aa, Homo sapiens
MTVARPSVPAALPLLGELPRLLLLVLLCLPAVWGDCGLPPDVPNAQPALEGRTSFPEDTVITYKCEESFVKIPGEKDSVICLKGSQWSDIEEFCNRSCEVPTRLNSASLKQPYITQNYFPVGTVVEYECRPGYRREPSLSPKLTCLQNLKWSTAVEFCKKKSCPNPGEIRNGQIDVPGGILFGATISFSCNTG

SEQ ID NO: 27 - protein, 363 aa, Homo sapiens
GHLIVISFSSAFVSLGDCGLPPDVPNAQPALEGRTSFPEDTVITYKCEESFVKIPGEKDSVICLKGSQWSDIEEFCNRSCEVPTRLNSASLKQPYITQNYFPVGTVVEYECRPGYRREPSLSPKLTCLQNLKWSTAVEFCKKKSCPNPGEIRNGQIDVPGGILFGATISFSCNTGYKLFGSTSSFCLISGSSVQWSDPLPECREIYCPAPPQIDNGIIQGERDHYGYRQSVTYACNKGFTMIGEHSIYCTVNNDEGEWSGPPPECRGKSLTSKVPPTVQKPTTVNVPTTEVSPTSQKTTTKTTTPNAQATRSTPVSRTTKHFHETTPNKGSGTTSGTTRLLSGHTCFTLTGLLGTLVTMGLLT

SEQ ID NO: 28 - protein, 265 aa, Homo sapiens
RPGYRREPSLSPKLTCLQNLKWSTAVEFCKKKSCPNPGEIRNGQIDVPGGILFGATISFSCNTGYKLFGSTSSFCLISGSSVQWSDPLPECREIYCPAPPQIDNGIIQGERDHYGYRQSVTYACNKGFTMIGEHSIYCTVNNDEGEWSGPPPECRGKSLTSKVPPTVQKPTTVNVPTTEVSPTSQKTTTKTTTPNAQATRSTPVSRTTKHFHETTPNKGSGTTSGQLTLFRFTEYGSNVLWWKYELDQDCRIKWSLIYCGQGFSY

SEQ ID NO: 29 - protein, 321 aa, Homo sapiens
GHLIVISFSSAFVSLGDCGLPPDVPNAQPALEGRTSFPEDTVITYKCEESFVKIPGEKDSVICLKGSQWSDIEEFCNRSCEVPTRLNSASLKQPYITQNYFPVGTVVEYECRPGYRREPSLSPKLTCLQNLKWSTAVEFCKKKSCPNPGEIRNGQIDVPGGILFGATISFSCNTGYKLFGSTSSFCLISGSSVQWSDPLPECREIYCPAPPQIDNGIIQGERDHYGYRQSVTYACNKGFTMIGEHSIYCTVNNDEGEWSGPPPECRATRSTPVSRTTKHFHETTPNKGSGTTSGTTRLLSGHTCFTLTGLLGTLVTMGLLT

SEQ ID NO: 30 - protein, 293 aa, Homo sapiens [sequence omitted]

SEQ ID NO: 31 - protein, 376 aa, Homo sapiens
GHLIVISFSSAFVSLGDCGLPPDVPNAQPALEGRTSFPEDTVITYKCEESFVKIPGEKDSVICLKGSQWSDIEEFCNRSCEVPTRLNSASLKQPYITQNYFPVGTVVEYECRPGYRREPSLSPKLTCLQNLKWSTAVEFCKKKSCPNPGEIRNGQIDVPGGILFGATISFSCNTGYKLFGSTSSFCLISGSSVQWSDPLPECREIYCPAPPQIDNGIIQGERDHYGYRQSVTYACNKGFTMIGEHSIYCTVNNDEGEWSGPPPECRGKSLTSKVPPTVQKPTTVNVPTTEVSPTSQKTTTKTTTPNAQATRSTPVSRTTKHFHETTPNKGSGTTSGQLTLFRFTEYGSNVLWWKYELDQDCRIKWSLIYCSQGFSY

SEQ ID NO: 32 - protein, 316 aa, Homo sapiens
SVQWSDPLPECREIYCPAPPQIDNGIIQGERDHYGYRQSVTYACNKGFTMIGEHSIYCTVNNDEGEWSGPPPECRGKSLTSKVPPTVQKPTTVNVPTTEVSPTSQKTTTKTTTPNAQGTETPSVLQKHTTENVSATRTPPTPQKPTTVNVPATIVTPTPQKPTTINVPATGVSSTPQRHTIVNVSATGTLPTLQKPTRANDSATKSPAAAQTSFISKTLSTKTPSAAQNPMMTNASATQATLTAQKFTTAKVAFTQSPSAAPTRSTPVSRTTKHFHETTPNKGSGTTSGTTRLLSGHTCFTLTGLLGTLVTMGLLT

SEQ ID NO: 33 - protein, 422 aa, Homo sapiens
RPGYRREPSLSPKLTCLQNLKWSTAVEFCKKKSCPNPGEIRNGQIDVPGGILFGATISFSCNTGYKLFGSTSSFCLISGSSVQWSDPLPECREIYCPAPPQIDNGIIQGERDHYGYRQSVTYACNKGFTMIGEHSIYCTVNNDEGEWSGPPPECRGKSLTSKVPPTVQKPTTVNVPTTEVSPTSQKTTTKTTTPNAQGAETPSVLQKHTTENVSATRTPPTPQKPTTVNVPATIVTPTPQKPTTINVPATGVSSTPQRHTIVNVSATGTLPTLQKPTRANDSATKSPAAAQTSFISKTLSTKTPSAAQNPMMTNASATQATLTAQRFTTAKVAFTQSPSAAHKSTNVHSPVTNGLKSTQRFPSAHITATRSTPVSRTTKHFHETTPNKGSGTTSGTTRLLSGHTCFTLTGLLGTLVTMGLLT

SEQ ID NO: 34 - protein, 381 aa, Homo sapiens
MTVARPSVPAALPLLGELPRLLLLVLLCLPAVWGDCGLPPDVPNAQPALEGRTSFPEDTVITYKCEESFVKIPGEKDSVICLKGSQWSDIEEFCNRSCEVPTRLNSASLKQPYITQNYFPVGTVVEYECRPGYRREPSLSPKLTCLQNLKWSTAVEFCKKKSCPNPGEIRNGQIDVPGGILFGATISFSCNTGYKLFGSTSSFCLISGSSVQWSDPLPECREIYCPAPPQIDNGIIQGERDHYGYRQSVTYACNKGFTMIGEHSIYCTVNNDEGEWSGPPPECRGKSLTSKVPPTVQKPTTVNVPTTEVSPTSQKTTTKTTTPNAQATRSTPVSRTTKHFHETTPNKGSGTTSGTTRLLSGHTCFTLTGLLGTLVTMGLLT

SEQ ID NO: 35 - protein, 419 aa, Homo sapiens
RPGYRREPSLSPKLTCLQNLKWSTAVEFCKKKSCPNPGEIRNGQIDVPGGILFGATISFSCNTGYKLFGSTSSFCLISGSSVQWSDPLPECREIYCPAPPQIDNGIIQGERDHYGYRQSVTYACNKGFTMIGEHSIYCTVNNDEGEWSGPPPECRGKSLTSKVPPTVQKPTTVNVPTTEVSPTSQKTTTKTTTPNAQGAETPSVLQKHTTENVSATRTPPTPQKPTTVNVPATIVTPTPQKPTTINVPATGVSSTPQRHTIVNVSATGTLPTLQKPTRANDSATKSPAAAQTSFISKTLSTKTPSAAQNPMMTNASATQATLTAQRFTTAKVAFTQSPSAAHKSTNVHSPVTNGLKSTQRFPSAHITATRSTPVSRTTKHFHETTPNKGSGTTSGTTRLLSALIMHMRATKYSMLCLTI

SEQ ID NO: 36 - protein, 440 aa, Homo sapiens
MTVARPSVPAALPLLGELPRLLLLVLLCLPAVWGDCGLPPDVPNAQPALEGRTSFPEDTVITYKCEESFVKIPGEKDSVICLKGSQWSDIEEFCNRSCEVPTRLNSASLKQPYITQNYFPVGTVVEYECRPGYRREPSLSPKLTCLQNLKWSTAVEFCKKKSCPNPGEIRNGQIDVPGGILFGATISFSCNTGYKLFGSTSSFCLISGSSVQWSDPLPECREIYCPAPPQIDNGIIQGERDHYGYRQSVTYACNKGFTMIGEHSIYCTVNNDEGEWSGPPPECRGKSLTSKVPPTVQKPTTVNVPTTEVSPTSQKTTTKTTTPNAQATRSTPVSRTTKHFHETTPNKGSGTTSGTTRLLSGSRPVTQAGMRWCDRSSLQSRTPGFKRSFHFSLPSSWYYRAHVFHVDRFAWDASNHGLADLAKEELRRKYTQVYRLFLVS

SEQ ID NO: 37 - DNA, 2367 bp, Homo sapiens
gcaggtggggagcttggcccgcggtcgtggttcccgccgtcctgtgcctttaaggctctcgccgctcaccagcatttggggctcctgctgtgtcggcccccagctgacttggctttaggggtcggcgtggagggttaaagaggccccggctgggtttgcggagcagccaagcctggcaaaatcgaaagggagggctcaaagagactgtatccttaacccccaaaaagctggtctaaaaggatgggaggccagaccgctgaccgttccccactctcgacagagtccagccgtgtggagcacacgatgctgcaaacttgcatgtcatctctttcaggtgtggcatttcaagggggcttgtgtcttgaaaacagcaactgtgaggacacttgatagtcatttccttcagttctgcttttgtctccctaggtgactgtggccttcccccagatgtacctaatgcccagccagctttggaaggccgtacaagttttcccgaggatactgtaataacgtacaaatgtgaagaaagctttgtgaaaattcctggcgagaaggactcagtgatctgccttaagggcagtcaatggtcagatattgaagagttctgcaatcgtagctgcgaggtgccaacaaggctaaattctgcatccctcaaacagccttatatcactcagaattattttccagtcggtactgttgtggaatatgagtgccgtccaggttacagaagagaaccttctctatcaccaaaactaacttgccttcagaatttaaaatggtccacagcagtcgaattttgtaaaaagaaatcatgccctaatccgggagaaatacgaaatggtcagattgatgtaccaggtggcatattatttggtgcaaccatctccttctcatgtaacacagggtacaaattatttggctcgacttctagtttttgtcttatttcaggcagctctgtccagtggagtgacccgttgccagagtgcagagaaatttattgtccagcaccaccacaaattgacaatggaataattcaaggggaacgtgaccattatggatatagacagtctgtaacgtatgcatgtaataaaggattcaccatgattggagagcactctatttattgtactgtgaataatgatgaaggagagtggagtggcccaccacctgaatgcagaggaaaatctctaacttccaaggtcccaccaacagttcagaaacctaccacagtaaatgttccaactacagaagtctcaccaacttctcagaaaaccaccacaaaaaccaccacaccaaatgctcaaggtacagagactccatcagttcttcaaaaacacaccacagaaaatgtttcagctacaagaaccccaccaactcctcagaaacccaccacagtaaatgtcccagctacaatagtcacaccaacacctcagaaacccaccacaataaatgttccagctacaggagtctcatcaacacctcaaagacacaccatagtaaatgtttcagctacaggaaccctaccaactcttcagaaacccaccagagcaaatgattcagccaccaaatccccagcagcagctcagacatctttcatatcaaaaaccctatctacaaagaccccttctgcagctcagaatcccatgatgacaaatgcttctgctacacaggccacactaacagcccaaaaattcaccacagcaaaagttgcatttacgcagagtccttcagcagcaccaacacggagtacacctgtttccaggacaaccaagcattttcatgaaacaaccccaaataaaggaagtggaaccacttcaggtactacccgtcttctatctgggcacacgtgtttcacgttgacaggtttgcttgggacgctagtaaccatgggcttgctgacttagccaaagaagagttaagaagaaaatacacacaagtatacagactgttcctagtttcttagacttatctgcatattggataaaataaatgcaattgtgctcttcatttaggatgctttcattgtctttaagatgtgttaggaatgtcaacagagcaaggagaaaaaaggcagtcctggaatcacattcttagcacacctacacctcttgaaaatagaacaacttgcagaattgagagtgattcctttcctaaaagtgtagtgatttttttccacaagatctgtaatgttatttccacttataaaggaaataaaaaatgaaaaacattatttggatatcaaaagcaaataaaaacccaattcagtctcttctaagcaaaattgctaaagagagatgaaccacattataaagtaatctttggctgtaaggcattttcatctttccttcgggttggcaaaatatttta

SEQ ID NO: 38 - DNA, 1970 bp, Homo sapiens
gcaggtggggagcttggcccgcggtcgtggttcccgccgtcctgtgcctttaaggctctcgccgctcaccagcatttggggctcctgctgtgtcggcccccagctgacttggctttaggggtcggcgtggagggttaaagaggccccggctgggtttgcggagcagccaagcctggcaaaatcgaaagggagggctcaaagagactgtatccttaacccccaaaaagctggtctaaaaggatgggaggccagaccgctgaccgttccccactctcgacagagtccagccgtgtggagcacacgatgctgcaaacttgcatgtcatctctttcaggtgtggcatttcaagggggcttgtgtcttgaaaacagcaactgtgaggacacttgatagtcatttccttcagttctgcttttgtctccctaggtgactgtggccttcccccagatgtacctaatgcccagccagctttggaaggccgtacaagttttcccgaggatactgtaataacgtacaaatgtgaagaaagctttgtgaaaattcctggcgagaaggactcagtgatctgccttaagggcagtcaatggtcagatattgaagagttctgcaatcgtagctgcgaggtgccaacaaggctaaattctgcatccctcaaacagccttatatcactcagaattattttccagtcggtactgttgtggaatatgagtgccgtccaggttacagaagagaaccttctctatcaccaaaactaacttgccttcagaatttaaaatggtccacagcagtcgaattttgtaaaaagaaatcatgccctaatccgggagaaatacgaaatggtcagattgatgtaccaggtggcatattatttggtgcaaccatctccttctcatgtaacacagggtacaaattatttggctcgacttctagtttttgtcttatttcaggcagctctgtccagtggagtgacccgttgccagagtgcagagaaatttattgtccagcaccaccacaaattgacaatggaataattcaaggggaacgtgaccattatggatatagacagtctgtaacgtatgcatgtaataaaggattcaccatgattggagagcactctatttattgtactgtgaataatgatgaaggagagtggagtggcccaccacctgaatgcagaggaaaatctctaacttccaaggtcccaccaacagttcagaaacctaccacagtaaatgttccaactacagaagtctcaccaacttctcagaaaaccaccacaaaaaccaccacaccaaatgctcaaggtacagagactccatcagttcttcaaaaacacaccacagaaaatgtttcagctacaagaaccccaccaactcctcagaaacccaccacagtaaatgtcccagctacaatagtcacaccaacacctcagaaacccaccacaataaatgttccagctacaggagtctcatcaacacctcaaagacacaccatagtaaatgtttcagctacaggaaccctaccaactcttcagaaacccaccagagcaaatgattcagccaccaaatccccagcagcagctcagacatctttcatatcaaaaaccctatctacaaagaccccttctgcagctcagaatcccatgatgacaaatgcttctgctacacaggccacactaacagcccaaaaattcaccacagcaaaagttgcatttacgcagagtccttcagcagcacgtaagtccactaatgtacattccccagtgactaatggtctcaagagtacacaaagattcccttctgctcatattacagcaacacggagtacacctgtttccaggacaaccaagcattttcatgaaacaaccccaaataaaggaagtggaaccacttcaggtactacccgtcttctatctgctcttataatgcacatgagagcaacaaagtactcaatgttgtgtttgaccatt

SEQ ID NO: 39 - DNA, 1964 bp, Homo sapiens
tatgacgccggagccctctgaccgcacctctgaccacaacaaacccctactccacccgtcttgtttgtcccacccttggtgacgcagagccccagcccagaccccgcccaaagcactcatttaactggtattgcggagccacgaggcttctgcttactgcaactcgctccggccgctgggcgtagctgcgactcggcggagtcccggcggcgcgtccttgttctaacccggcgcgccatgaccgtcgcgcggccgagcgtgcccgcggcgctgcccctcctcggggagctgccccggctgctgctgctggtgctgttgtgcctgccggccgtgtggggtgactgtggccttcccccagatgtacctaatgcccagccagctttggaaggccgtacaagttttcccgaggatactgtaataacgtacaaatgtgaagaaagctttgtgaaaattcctggcgagaaggactcagtgatctgccttaagggcagtcaatggtcagatattgaagagttctgcaatcgtagctgcgaggtgccaacaaggctaaattctgcatccctcaaacagccttatatcactcagaattattttccagtcggtactgttgtggaatatgagtgccgtccaggttacagaagagaaccttctctatcaccaaaactaacttgccttcagaatttaaaatggtccacagcagtcgaattttgtaaaaagaaatcatgccctaatccgggagaaatacgaaatggtcagattgatgtaccaggtggcatattatttggtgcaaccatctccttctcatgtaacacagggtacaaattatttggctcgacttctagtttttgtcttatttcaggcagctctgtccagtggagtgacccgttgccagagtgcagagaaatttattgtccagcaccaccacaaattgacaatggaataattcaaggggaacgtgaccattatggatatagacagtctgtaacgtatgcatgtaataaaggattcaccatgattggagagcactctatttattgtactgtgaataatgatgaaggagagtggagtggcccaccacctgaatgcagaggaaaatctctaacttccaaggtcccaccaacagttcagaaacctaccacagtaaatgttccaactacagaagtctcaccaacttctcagaaaaccaccacaaaaaccaccacaccaaatgctcaagcaacacggagtacacctgtttccaggacaaccaagcattttcatgaaacaaccccaaataaaggaagtggaaccacttcaggtactacccgtcttctatctggttctcgtcctgtcacccaggctggtatgcggtggtgtgatcgtagctcactgcagtctcgaactcctgggttcaagcgatccttccacttcagcctcccaagtagctggtactacagggcacacgtgtttcacgttgacaggtttgcttgggacgctagtaaccatgggcttgctgacttagccaaagaagagttaagaagaaaatacacacaagtatacagactgttcctagtttcttagacttatctgcatattggataaaataaatgcaattgtgctcttcatttaggatgctttcattgtctttaagatgtgttaggaatgtcaacagagcaaggagaaaaaaggcagtcctggaatcacattcttagcacacctacacctcttgaaaatagaacaacttgcagaattgagagtgattcctttcctaaaagtgtagtgatttttttccacaagatctgtaatgttatttccacttataaaggaaataaaaaatgaaaaacattatttggatatcaaaagcaaataaaaacccaattcagtctcttctaagcaaaattgctaaagagagatgaaccacattataaagtaatctttggctgtaaggcattttcatctttccttcgggttggcaaaatatttta

SEQ ID NO: 40 - DNA, 1935 bp, Homo sapiens
gcaggtggggagcttggcccgcggtcgtggttcccgccgtcctgtgcctttaaggctctcgccgctcaccagcatttggggctcctgctgtgtcggcccccagctgacttggctttaggggtcggcgtggagggttaaagaggccccggctgggtttgcggagcagccaagcctggcaaaatcgaaagggagggctcaaagagactgtatccttaacccccaaaaagctggtctaaaaggatgggaggccagaccgctgaccgttccccactctcgacagagtccagccgtgtggagcacacgatgctgcaaacttgcatgtcatctctttcaggtgtggcatttcaagggggcttgtgtcttgaaaacagcaactgtgaggacacttgatagtcatttccttcagttctgcttttgtctccctaggtgactgtggccttcccccagatgtacctaatgcccagccagctttggaaggccgtacaagttttcccgaggatactgtaataacgtacaaatgtgaagaaagctttgtgaaaattcctggcgagaaggactcagtgatctgccttaagggcagtcaatggtcagatattgaagagttctgcaatcgtagctgcgaggtgccaacaaggctaaattctgcatccctcaaacagccttatatcactcagaattattttccagtcggtactgttgtggaatatgagtgccgtccaggttacagaagagaaccttctctatcaccaaaactaacttgccttcagaatttaaaatggtccacagcagtcgaattttgtaaaaagaaatcatgccctaatccgggagaaatacgaaatggtcagattgatgtaccaggtggcatattatttggtgcaaccatctccttctcatgtaacacagggtacaaattatttggctcgacttctagtttttgtcttatttcaggcagctctgtccagtggagtgacccgttgccagagtgcagagaaatttattgtccagcaccaccacaaattgacaatggaataattcaaggggaacgtgaccattatggatatagacagtctgtaacgtatgcatgtaataaaggattcaccatgattggagagcactctatttattgtactgtgaataatgatgaaggagagtggagtggcccaccacctgaatgcagaggaaaatctctaacttccaaggtcccaccaacagttcagaaacctaccacagtaaatgttccaactacagaagtctcaccaacttctcagaaaaccaccacaaaaaccaccacaccaaatgctcaagcaacacggagtacacctgtttccaggacaaccaagcattttcatgaaacaaccccaaataaaggaagtggaaccacttcaggtactacccgtcttctatctgggcacacgtgtttcacgttgacaggtttgcttgggacgctagtaaccatgggcttgctgacttagccaaagaagagttaagaagaaaatacacacaagtatacagactgttcctagtttcttagacttatctgcatattggataaaataaatgcaattgtgctcttcatttaggatgctttcattgtctttaagatgtgttaggaatgtcaacagagcaaggagaaaaaaggcagtcctggaatcacattcttagcacacctacacctcttgaaaatagaacaacttgcagaattgagagtgattcctttcctaaaagtgtagtgatttttttccacaagatctgtaatgttatttccacttataaaggaaataaaaaatgaaaaacattatttggatatcaaaagcaaataaaaacccaattcagtctcttctaagcaaaattgctaaagagagatgaaccacattataaagtaatctttggctgtaaggcattttcatctttccttcgggttggcaaaatatttta

SEQ ID NO: 41 - DNA, 1636 bp, Homo sapiens
gcaggtggggagcttggcccgcggtcgtggttcccgccgtcctgtgcctttaaggctctcgccgctcaccagcatttggggctcctgctgtgtcggcccccagctgacttggctttaggggtcggcgtggagggttaaagaggccccggctgggtttgcggagcagccaagcctggcaaaatcgaaagggagggctcaaagagactgtatccttaacccccaaaaagctggtctaaaaggatgggaggccagaccgctgaccgttccccactctcgacagagtccagccgtgtggagcacacgatgctgcaaacttgcatgtcatctctttcaggtgtggcatttcaagggggcttgtgtcttgaaaacagcaactgtgaggacacttgatagtcatttccttcagttctgcttttgtctccctaggtgactgtggccttcccccagatgtacctaatgcccagccagctttggaaggccgtacaagttttcccgaggatactgtaataacgtacaaatgtgaagaaagctttgtgaaaattcctggcgagaaggactcagtgatctgccttaagggcagtcaatggtcagatattgaagagttctgcaatcgtagctgcgaggtgccaacaaggctaaattctgcatccctcaaacagccttatatcactcagaattattttccagtcggtactgttgtggaatatgagtgccgtccaggttacagaagagaaccttctctatcaccaaaactaacttgccttcagaatttaaaatggtccacagcagtcgaattttgtaaaaagaaatcatgccctaatccgggagaaatacgaaatggtcagattgatgtaccaggtggcatattatttggtgcaaccatctccttctcatgtaacacagggtacaaattatttggctcgacttctagtttttgtcttatttcaggcagctctgtccagtggagtgacccgttgccagagtgcagagaaatttattgtccagcaccaccacaaattgacaatggaataattcaaggggaacgtgaccattatggatatagacagtctgtaacgtatgcatgtaataaaggattcaccatgattggagagcactctatttattgtactgtgaataatgatgaaggagagtggagtggcccaccacctgaatgcagaggaaaatctctaacttccaaggtcccaccaacagttcagaaacctaccacagtaaatgttccaactacagaagtctcaccaacttctcagaaaaccaccacaaaaaccaccacaccaaatgctcaagcaacacggagtacacctgtttccaggacaaccaagcattttcatgaaacaaccccaaataaaggaagtggaaccacttcaggtcagttgacactgttcaggtttactgagtatggatctaatgtgctatggtggaaatatgaacttgaccaagattgcaggattaaatggtctctaatttattgtagccagggtttttcatactaatactttttactttatttggaagcggacttggattgtactagggcaaatctttaaaaaaagaaacatttacaataatagagaaaaagactgtggccccattaaaaaaatgctaaattaagattggt

SEQ ID NO: 42 - DNA, 1809 bp, Homo sapiens
gcaggtggggagcttggcccgcggtcgtggttcccgccgtcctgtgcctttaaggctctcgccgctcaccagcatttggggctcctgctgtgtcggcccccagctgacttggctttaggggtcggcgtggagggttaaagaggccccggctgggtttgcggagcagccaagcctggcaaaatcgaaagggagggctcaaagagactgtatccttaacccccaaaaagctggtctaaaaggatgggaggccagaccgctgaccgttccccactctcgacagagtccagccgtgtggagcacacgatgctgcaaacttgcatgtcatctctttcaggtgtggcatttcaagggggcttgtgtcttgaaaacagcaactgtgaggacacttgatagtcatttccttcagttctgcttttgtctccctaggtgactgtggccttcccccagatgtacctaatgcccagccagctttggaaggccgtacaagttttcccgaggatactgtaataacgtacaaatgtgaagaaagctttgtgaaaattcctggcgagaaggactcagtgatctgccttaagggcagtcaatggtcagatattgaagagttctgcaatcgtagctgcgaggtgccaacaaggctaaattctgcatccctcaaacagccttatatcactcagaattattttccagtcggtactgttgtggaatatgagtgccgtccaggttacagaagagaaccttctctatcaccaaaactaacttgccttcagaatttaaaatggtccacagcagtcgaattttgtaaaaagaaatcatgccctaatccgggagaaatacgaaatggtcagattgatgtaccaggtggcatattatttggtgcaaccatctccttctcatgtaacacagggtacaaattatttggctcgacttctagtttttgtcttatttcaggcagctctgtccagtggagtgacccgttgccagagtgcagagaaatttattgtccagcaccaccacaaattgacaatggaataattcaaggggaacgtgaccattatggatatagacagtctgtaacgtatgcatgtaataaaggattcaccatgattggagagcactctatttattgtactgtgaataatgatgaaggagagtggagtggcccaccacctgaatgcagagcaacacggagtacacctgtttccaggacaaccaagcattttcatgaaacaaccccaaataaaggaagtggaaccacttcaggtactacccgtcttctatctgggcacacgtgtttcacgttgacaggtttgcttgggacgctagtaaccatgggcttgctgacttagccaaagaagagttaagaagaaaatacacacaagtatacagactgttcctagtttcttagacttatctgcatattggataaaataaatgcaattgtgctcttcatttaggatgctttcattgtctttaagatgtgttaggaatgtcaacagagcaaggagaaaaaaggcagtcctggaatcacattcttagcacacctacacctcttgaaaatagaacaacttgcagaattgagagtgattcctttcctaaaagtgtagtgatttttttccacaagatctgtaatgttatttccacttataaaggaaataaaaaatgaaaaacattatttggatatcaaaagcaaataaaaacccaattcagtctcttctaagcaaaattgctaaagagagatgaaccacattataaagtaatctttggctgtaaggcattttcatctttccttcgggttggcaaaatatttta

SEQ ID NO: 43 - DNA, 2445 bp, Homo sapiens
gcaggtggggagcttggcccgcggtcgtggttcccgccgtcctgtgcctttaaggctctcgccgctcaccagcatttggggctcctgctgtgtcggcccccagctgacttggctttaggggtcggcgtggagggttaaagaggccccggctgggtttgcggagcagccaagcctggcaaaatcgaaagggagggctcaaagagactgtatccttaacccccaaaaagctggtctaaaaggatgggaggccagaccgctgaccgttccccactctcgacagagtccagccgtgtggagcacacgatgctgcaaacttgcatgtcatctctttcaggtgtggcatttcaagggggcttgtgtcttgaaaacagcaactgtgaggacacttgatagtcatttccttcagttctgcttttgtctccctaggtgactgtggccttcccccagatgtacctaatgcccagccagctttggaaggccgtacaagttttcccgaggatactgtaataacgtacaaatgtgaagaaagctttgtgaaaattcctggcgagaaggactcagtgatctgccttaagggcagtcaatggtcagatattgaagagttctgcaatcgtagctgcgaggtgccaacaaggctaaattctgcatccctcaaacagccttatatcactcagaattattttccagtcggtactgttgtggaatatgagtgccgtccaggttacagaagagaaccttctctatcaccaaaactaacttgccttcagaatttaaaatggtccacagcagtcgaattttgtaaaaagaaatcatgccctaatccgggagaaatacgaaatggtcagattgatgtaccaggtggcatattatttggtgcaaccatctccttctcatgtaacacagggtacaaattatttggctcgacttctagtttttgtcttatttcaggcagctctgtccagtggagtgacccgttgccagagtgcagagaaatttattgtccagcaccaccacaaattgacaatggaataattcaaggggaacgtgaccattatggatatagacagtctgtaacgtatgcatgtaataaaggattcaccatgattggagagcactctatttattgtactgtgaataatgatgaaggagagtggagtggcccaccacctgaatgcagaggaaaatctctaacttccaaggtcccaccaacagttcagaaacctaccacagtaaatgttccaactacagaagtctcaccaacttctcagaaaaccaccacaaaaaccaccacaccaaatgctcaaggtacagagactccatcagttcttcaaaaacacaccacagaaaatgtttcagctacaagaaccccaccaactcctcagaaacccaccacagtaaatgtcccagctacaatagtcacaccaacacctcagaaacccaccacaataaatgttccagctacaggagtctcatcaacacctcaaagacacaccatagtaaatgtttcagctacaggaaccctaccaactcttcagaaacccaccagagcaaatgattcagccaccaaatccccagcagcagctcagacatctttcatatcaaaaaccctatctacaaagaccccttctgcagctcagaatcccatgatgacaaatgcttctgctacacaggccacactaacagcccaaaaattcaccacagcaaaagttgcatttacgcagagtccttcagcagcacgtaagtccactaatgtacattccccagtgactaatggtctcaagagtacacaaagattcccttctgctcatattacagcaacacggagtacacctgtttccaggacaaccaagcattttcatgaaacaaccccaaataaaggaagtggaaccacttcaggtactacccgtcttctatctgggcacacgtgtttcacgttgacaggtttgcttgggacgctagtaaccatgggcttgctgacttagccaaagaagagttaagaagaaaatacacacaagtatacagactgttcctagtttcttagacttatctgcatattggataaaataaatgcaattgtgctcttcatttaggatgctttcattgtctttaagatgtgttaggaatgtcaacagagcaaggagaaaaaaggcagtcctggaatcacattcttagcacacctacacctcttgaaaatagaacaacttgcagaattgagagtgattcctttcctaaaagtgtagtgatttttttccacaagatctgtaatgttatttccacttataaaggaaataaaaaatgaaaaacattatttggatatcaaaagcaaataaaaacccaattcagtctcttctaagcaaaattgctaaagagagatgaaccacattataaagtaatctttggctgtaaggcattttcatctttccttcgggttggcaaaatatttta

SEQ ID NO: 44 - DNA, 1636 bp, Homo sapiens; identical to SEQ ID NO: 41

SEQ ID NO: 45 - DNA, 2367 bp, Homo sapiens; identical to SEQ ID NO: 37

SEQ ID NO: 46 - DNA, 2445 bp, Homo sapiens; identical to SEQ ID NO: 43

SEQ ID NO: 47 - DNA, 2640 bp, Homo sapiens
tatgacgccggagccctctgaccgcacctctgaccacaacaaacccctactccacccgtcttgtttgtcccacccttggtgacgcagagccccagcccagaccccgcccaaagcactcatttaactggtattgcggagccacgaggcttctgcttactgcaactcgctccggccgctgggcgtagctgcgactcggcggagtcccggcggcgcgtccttgttctaacccggcgcgccatgaccgtcgcgcggccgagcgtgcccgcggcgctgcccctcctcggggagctgccccggctgctgctgctggtgctgttgtgcctgccggccgtgtggggtgactgtggccttcccccagatgtacctaatgcccagccagctttggaaggccgtacaagttttcccgaggatactgtaataacgtacaaatgtgaagaaagctttgtgaaaattcctggcgagaaggactcagtgatctgccttaagggcagtcaatggtcagatattgaagagttctgcaatcgtagctgcgaggtgccaacaaggctaaattctgcatccctcaaacagccttatatcactcagaattattttccagtcggtactgttgtggaatatgagtgccgtccaggttacagaagagaaccttctctatcaccaaaactaacttgccttcagaatttaaaatggtccacagcagtcgaattttgtaaaaagaaatcatgccctaatccgggagaaatacgaaatggtcagattgatgtaccaggtggcatattatttggtgcaaccatctccttctcatgtaacacagggtacaaattatttggctcgacttctagtttttgtcttatttcaggcagctctgtccagtggagtgacccgttgccagagtgcagagaaatttattgtccagcaccaccacaaattgacaatggaataattcaaggggaacgtgaccattatggatatagacagtctgtaacgtatgcatgtaataaaggattcaccatgattggagagcactctatttattgtactgtgaataatgatgaaggagagtggagtggcccaccacctgaatgcagaggaaaatctctaacttccaaggtcccaccaacagttcagaaacctaccacagtaaatgttccaactacagaagtctcaccaacttctcagaaaaccaccacaaaaaccaccacaccaaatgctcaagcaacacggagtacacctgtttccaggacaaccaagcattttcatgaaacaaccccaaataaaggaagtggaaccacttcaggtactacccgtcttctatctgggcacacgtgtttcacgttgacaggtttgcttgggacgctagtaaccatgggcttgctgacttagccaaagaagagttaagaagaaaatacacacaagtatacagactgttcctagtttcttagacttatctgcatattggataaaataaatgcaattgtgctcttcatttaggatgctttcattgtctttaagatgtgttaggaatgtcaacagagcaaggagaaaaaaggcagtcctggaatcacattcttagcacacctacacctcttgaaaatagaacaacttgcagaattgagagtgattcctttcctaaaagtgtaagaaagcatagagatttgttcgtatttagaatgggatcacgaggaaaagagaaggaaagtgatttttttccacaagatctgtaatgttatttccacttataaaggaaataaaaaatgaaaaacattatttggatatcaaaagcaaataaaaacccaattcagtctcttctaagcaaaattgctaaagagagatgaaccacattataaagtaatctttggctgtaaggcattttcatctttccttcgggttggcaaaatattttaaaggtaaaacatgctggtgaaccaggggtgttgatggtgataagggaggaatatagaatgaaagactgaatcttcctttgttgcacaaatagagtttggaaaaagcctgtgaaaggtgtcttctttgacttaatgtctttaaaagtatccagagatactacaatattaacataagaaaagattatatattatttctgaatcgagatgtccatagtcaaatttgtaaatcttattcttttgtaatatttatttatatttatttatgacagtgaacattctgattttacatgtaaaacaagaaaagttgaagaagatatgtgaagaaaaatgtatttttcctaaatagaaataaatgatcccattttttggtatcatgtagtatgtgaaatttattcttaaacgtgactactttatttctaaataagaaattccctacctgcttcctacaagcagttcagaatgccatgccttggttgtcctagtgtgaataattttcagctactttaaaattatattgtactttctcaagcatgtcatatcctttcctattagagtatctatattacttgttactgatttacctgaaggcaatctgattaatttctaggtttttaccatattcttgtcatcttgccaattacattttaagtgttagactagactaagatgtactagttgtatagaatataactagatttattatggcaatgtttattttgtcattttgcttcatctg

SEQ ID NO: 48 - DNA, 1846 bp, Homo sapiens
tatgacgccggagccctctgaccgcacctctgaccacaacaaacccctactccacccgtcttgtttgtcccacccttggtgacgcagagccccagcccagaccccgcccaaagcactcatttaactggtattgcggagccacgaggcttctgcttactgcaactcgctccggccgctgggcgtagctgcgactcggcggagtcccggcggcgcgtccttgttctaacccggcgcgccatgaccgtcgcgcggccgagcgtgcccgcggcgctgcccctcctcggggagctgccccggctgctgctgctggtgctgttgtgcctgccggccgtgtggggtgactgtggccttcccccagatgtacctaatgcccagccagctttggaaggccgtacaagttttcccgaggatactgtaataacgtacaaatgtgaagaaagctttgtgaaaattcctggcgagaaggactcagtgatctgccttaagggcagtcaatggtcagatattgaagagttctgcaatcgtagctgcgaggtgccaacaaggctaaattctgcatccctcaaacagccttatatcactcagaattattttccagtcggtactgttgtggaatatgagtgccgtccaggttacagaagagaaccttctctatcaccaaaactaacttgccttcagaatttaaaatggtccacagcagtcgaattttgtaaaaagaaatcatgccctaatccgggagaaatacgaaatggtcagattgatgtaccaggtggcatattatttggtgcaaccatctccttctcatgtaacacagggtacaaattatttggctcgacttctagtttttgtcttatttcaggcagctctgtccagtggagtgacccgttgccagagtgcagagaaatttattgtccagcaccaccacaaattgacaatggaataattcaaggggaacgtgaccattatggatatagacagtctgtaacgtatgcatgtaataaaggattcaccatgattggagagcactctatttattgtactgtgaataatgatgaaggagagtggagtggcccaccacctgaatgcagaggaaaatctctaacttccaaggtcccaccaacagttcagaaacctaccacagtaaatgttccaactacagaagtctcaccaacttctcagaaaaccaccacaaaaaccaccacaccaaatgctcaagcaacacggagtacacctgtttccaggacaaccaagcattttcatgaaacaaccccaaataaaggaagtggaaccacttcaggtactacccgtcttctatctgggcacacgtgtttcacgttgacaggtttgcttgggacgctagtaaccatgggcttgctgacttagccaaagaagagttaagaagaaaatacacacaagtatacagactgttcctagtttcttagacttatctgcatattggataaaataaatgcaattgtgctcttcatttaggatgctttcattgtctttaagatgtgttaggaatgtcaacagagcaaggagaaaaaaggcagtcctggaatcacattcttagcacacctacacctcttgaaaatagaacaacttgcagaattgagagtgattcctttcctaaaagtgtagtgatttttttccacaagatctgtaatgttatttccacttataaaggaaataaaaaatgaaaaacattatttggatatcaaaagcaaataaaaacccaattcagtctcttctaagcaaaattgctaaagagagatgaaccacattataaagtaatctttggctgtaaggcattttcatctttccttcgggttggcaaaatatttta

SEQ ID NO: 49 - DNA, 1970 bp, Homo sapiens; identical to SEQ ID NO: 38

SEQ ID NO: 50 - DNA, 1964 bp, Homo sapiens; identical to SEQ ID NO: 39

SEQ ID NO: 51 - protein, 559 aa, Homo sapiens
MNDYGFIYQGSKNWIRPCPWNYGQFEDKIIDICLKLLDKSLHFQTDPATDCALRGSPVYVSRVVCAMINSNDDNGVLNGNWSENYTDGANPAEWTGSVAILKQWNATGCQPVRYGQCWVFAAVMCTVMRCLGIPTRVITNFDSGHDTDGNLIIDEYYDNTGRILGNKKKDTIWNFHVWNECWMARKDLPPAYGGWQVLDATPQEMSNGVYCCGPASVRAIKEGEVDLNYDTPFVFSMVNADCMSWLVQGGKEQKLHQDTSSVGNFISTKSIQSDERDDITENYKYEEGSLQERQVFLKALQKLKARSFHGSQRGAELQPSRPTSLSQDSPRSLHTPSLRPSDVVQVSLKFKLLDPPNMGQDICFVLLALNMSSQFKDLKVNLSAQSLLHDGSPLSPFWQDTAFITLSPKEAKTYPCKISYSQYSQYLSTDKLIRISALGEEKSSPEKILVNKIITLSYPSITINVLGAAVVNQPLSIQVIFSNPLSEQVEDCVLTVEGSGLFKKQQKVFLGVLKPQHQASIILETVPFKSGQRQIQANMRSNKFKDIKGYRNVYVDFAL

SEQ ID NO: 52 - protein, 349 aa, Homo sapiens
MAEELVLERCDLELETNGRDHHTADLCREKLVVRRGQPFWLTLHFEGRNYEASVDSLTFSVVTGPAPSQEAGTKARFPLRDAVEEGDWTATVVDQQDCTLSLQLTTPANAPIGLYRLSLEASTGYQGSSFVLGHFILLFNAWCPADAVYLDSEEERQEYVLTQQGFIYQGSAKFIKNIPWNFGQFEDGILDICLILLDVNPKFLKNAGRDCSRRSSPVYVGRVVSGMVNCNDDQGVLLGRWDNNYGDGVSPMSWIGSVDILRRWKNHGCQRVKYGQCWVFAAVACTGELHAGMWVMSPGRGHEEHWSRNQDIPALVLPPATNTLNALCGLEPVTTLSGPLSNSHPSSGC

SEQ ID NO: 53 - protein, 638 aa, Homo sapiens
MAQGLEVALTDLQSSRNNVRHHTEEITVDHLLVRRGQAFNLTLYFRNRSFQPGLDNIIFVVETEDAVYLDSEPQRQEYVMNDYGFIYQGSKNWIRPCPWNYGQFEDKIIDICLKLLDKSLHFQTDPATDCALRGSPVYVSRVVCAMINSNDDNGVLNGNWSENYTDGANPAEWTGSVAILKQWNATGCQPVRYGQCWVFAAVMCTVMRCLGIPTRVITNFDSGHDTDGNLIIDEYYDNTGRILGNKKKDTIWNFHVWNECWMARKDLPPAYGGWQVLDATPQEMSNGVYCCGPASVRAIKEGEVDLNYDTPFVFSMVNADCMSWLVQGGKEQKLHQDTSSVGNFISTKSIQSDERDDITENYKYEEGSLQERQVFLKALQKLKARSFHGSQRGAELQPSRPTSLSQDSPRSLHTPSLRPSDVVQVSLKFKLLDPPNMGQDICFVLLALNMSSQFKDLKVNLSAQSLLHDGSPLSPFWQDTAFITLSPKEAKTYPCKISYSQYSQYLSTDKLIRISALGEEKSSPEKILVNKIITLSYPSITINVLGAAVVNQPLSIQVIFSNPLSEQVEDCVLTVEGSGLFKKQQKVFLGVLKPQHQASIILETVPFKSGQRQIQANMRSNKFKDIKGYRNVYVDFAL

SEQ ID NO: 54 - protein, 560 aa, Homo sapiens [sequence omitted]

SEQ ID NO: 55 - protein, 687 aa, Homo sapiens
MAEELVLERCDLELETNGRDHHTADLCREKLVVRRGQPFWLTLHFEGRNYEASVDSLTFSVVTGPAPSQEAGTKARFPLRDAVEEGDWTATVVDQQDCTLSLQLTTPANAPIGLYRLSLEASTGYQGSSFVLGHFILLFNAWCPADAVYLDSEEERQEYVLTQQGFIYQGSAKFIKNIPWNFGQFEDGILDICLILLDVNPKFLKNAGRDCSRRSSPVYVGRVVSGMVNCNDDQGVLLGRWDNNYGDGVSPMSWIGSVDILRRWKNHGCQRVKYGQCWVFAAVACTVLRCLGIPTRVVTNYNSAHDQNSNLLIEYFRNEFGEIQGDKSEMIWNFHCWVESWMTRPDLQPGYEGWQALDPTPQEKSEGTYCCGPVPVRAIKEGDLSTKYDAPFVFAEVNADVVDWIQQDDGSVHKSINRSLIVGLKISTKSVGRDEREDITHTYKYPEGSSEEREAFTRANHLNKLAEKEETGMAMRIRVGQSMNMGSDFDVFAHITNNTAEEYVCRLLLCARTVSYNGILGPECGTKYLLNLNLEPFSEKSVPLCILYEKYRDCLTESNLIKVRALLVEPVINSYLLAERDLYLENPEIKIRILGEPKQKRKLVAEVSLQNPLPVALEGCTFTVEGAGLTEEQKTVEIPDPVEAGEEVKVRMDLLPLHMGLHKLVVNFESDKLKAVKGFRNVIIGPA

SEQ ID NO: 56 - protein, 548 aa, Homo sapiens
MAEELVLERCDLELETNGRDHHTADLCREKLVVRRGQPFWLTLHFEGRNYEASVDSLTFSVVTGPAPSQEAGTKARFPLRDAVEEGDWTATVVDQQDCTLSLQLTTPANAPIGLYRLSLEASTGYQGSSFVLGHFILLFNAWCPADAVYLDSEEERQEYVLTQQGFIYQGSAKFIKNIPWNFGQFEDGILDICLILLDVNPKFLKNAGRDCSRRSSPVYVGRVVSGMVNCNDDQGVLLGRWDNNYGDGVSPMSWIGSVDILRRWKNHGCQRVKYGQCWVFAAVACTVLRCLGIPTRVVTNYNSAHDQNSNLLIEYFRNEFGEIQGDKSEMIWNFHCWVESWMTRPDLQPGYEGWQALDPTPQEKSEGTYCCGPVPVRAIKEGDLSTKYDAPFVFAEVNADVVDWIQQDDGSVHKSINRSLIVGLKISTKSVGRDEREDITHTYKYPEGSSEEREAFTRANHLNKLAEKEETGMAMRIRVGQSMNMGSDFDVFAHITNNTAEEYVCRLLLCARTVSYNGILGPECGTKYLLNLNLEPFSGKALCSWSIC

SEQ ID NO: 57 - protein, 101 aa, Homo sapiens
GSSEEREAFTRANHLNKLAEKEETGMAMRIRVGQSMNMGSDFDVFAHITNNTAEEYVCRLLLCARTVSYNGILGPECGTKYLLNLNLEPFSGKALCSWSIC

SEQ ID NO: 58 - protein, 687 aa, Homo sapiens
MAEELVLERCDLELETNGRDHHTADLCREKLVVRRGQPFWLTLHFEGRNYQASVDSLTFSVVTGPAPSQEAGTKARFPLRDAVEEGDWTATVVDQQDCTLSLQLTTPANAPIGLYRLSLEASTGYQGSSFVLGHFILLFNAWCPADAVYLDSEEERQEYVLTQQGFIYQGSAKFIKNIPWNFGQFQDGILDICLILLDVNPKFLKNAGRDCSRRSSPVYVGRVGSGMVNCNDDQGVLLGRWDNNYGDGVSPMSWIGSVDILRRWKNHGCQRVKYGQCWVFAAVACTVLRCLGIPTRVVTNYNSAHDQNSNLLIEYFRNEFGEIQGDKSEMIWNFHCWVESWMTRPDLQPGYEGWQALDPTPQEKSEGTYCCGPVPVRAIKEGDLSTKYDAPFVFAEVNADVVDWIQQDDGSVHKSINRSLIVGLKISTKSVGRDEREDITHTYKYPEGSSEEREAFTRANHLNKLAEKEETGMAMRIRVGQSMNMGSDFDVFAHITNNTAEEYVCRLLLCARTVSYNGILGPECGTKYLLNLTLEPFSEKSVPLCILYEKYRDCLTESNLIKVRALLVEPVINSYLLAERDLYLENPEIKIRILGEPKQKRKLVAEVSLQNPLPVALEGCTFTVEGAGLTEEQKTVEIPDPVEAGEEVKVRMDLVPLHMGLHKLVVNFESDKLKAVKGFRNVIIGPA

SEQ ID NO: 59 - protein, 720 aa, Homo sapiens
MAQGLEVALTDLQSSRNNVRHHTEEITVDHLLVRRGQAFNLTLYFRNRSFQPGLDNIIFVVETGPLPDLALGTRAVFSLARHHSPSPWIAWLETNGATSTEVSLCAPPTAAVGRYLLKIHIDSFQGSVTAYQLGEFILLFNPWCPEDAVYLDSEPQRQEYVMNDYGFIYQGSKNWIRPCPWNYGQFEDKIIDICLKLLDKSLHFQTDPATDCALRGSPVYVSRVVCAMINSNDDNGVLNGNWSENYTDGANPAEWTGSVAILKQWNATGCQPVRYGQCWVFAAVMCTVMRCLGIPTRVITNFDSGHDTDGNLIIDEYYDNTGRILGNKKKDTIWNFHVWNECWMARKDLPPAYGGWQVLDATPQEMSNGVYCCGPASVRAIKEGEVDLNYDTPFVFSMVNADCMSWLVQGGKEQKLHQDTSSVGNFISTKSIQSDERDDITENYKYEEGSLQERQVFLKALQKLKARSFHGSQRGAELQPSRPTSLSQDSPRSLHTPSLRPSDVVQVSLKFKLLDPPNMGQDICFVLLALNMSSQFKDLKVNLSAQSLLHDGSPLSPFWQDTAFITLSPKEAKTYPCKISYSQYSQYLSTDKLIRISALGEEKSSPEKILVNKIITLSYPSITINVLGAAVVNQPLSIQVIFSNPLSEQVEDCVLTVEGSGLFKKQQKVFLGVLKPQHQASIILETVPFKSGQRQIQANMRSNKFKDIKGYRNVYVDFAL

SEQ ID NO: 60 - DNA, 2202 bp, Homo sapiens
ggctgccccattgcagggctagaagtggccctcacagacctccagagctccagaaataatgtgcggcaccacacggaggagatcactgtggaccacctgcttgttcgccggggccaggccttcaacctcaccctgtacttcaggaaccggagcttccagccaggcctggacaacatcatcttcgtggttgaaactggaccgctgccagacctggccttggggactcgggctgtgttcagcctggcacgccatcacagccccagcccctggattgcctggctggagaccaatggggccacctccacagaggtgagcttgtgcgctcctcccacggcggccgtgggtcggtacctcttgaaaatccacatcgactccttccaggggtctgtgacggcctaccagctaggggagttcatcctgcttttcaatccctggtgcccagaggatgctgtctacttggacagtgaaccccagaggcaggagtatgtcatgaatgattatggcttcatctaccaaggcagcaagaactggatccgcccatgtccctggaactatggacagtttgaagacaaaatcatagacatctgcctgaagctgctagacaagagcctgcacttccagactgacccagccacagactgtgctctgcggggaagccccgtctacgtcagcagagtggtgtgtgccatgatcaacagcaatgatgataatggggtgctcaatggaaactggagtgagaattacacagacggcgccaaccctgcggagtggacgggcagcgtggccatcctgaagcagtggaacgccacaggctgccagcccgtgcgctacgggcaatgctgggtctttgctgccgtcatgtgcacagtgatgaggtgtctggggatccctacccgtgtgatcaccaacttcgactctggccacgatacagatggaaacctgatcatagatgagtattatgacaacacaggcaggattttggggaataagaagaaggatactatctggaacttccatgtctggaatgagtgctggatggcccggaaggatctgccccctgcatatggaggctggcaggtgctggacgccacacctcaggagatgagcaacggcgtctactgctgtggccctgcctctgtcagagccatcaaagaaggagaagtggacctgaactatgacacgccctttgtgttttcgatggtgaatgctgactgcatgtcctggctcgtccagggagggaaggagcagaagcttcaccaggacacgagttctgttggcaattttatcagcacaaagagcatccagagtgacgagcgggatgacatcacagagaactacaagtatgaagaaggatccctccaggagaggcaggtgtttctgaaggctctgcagaagctgaaggctagaagcttccatggctcccaaagaggagcagagttgcaaccttccaggcccacatcactgagccaggacagccctcggagcctgcatacaccttcccttcgacccagtgatgtggtgcaagtctccctgaaattcaagctgctcgacccgcccaacatgggccaggatatatgctttgtcctgctggccctcaacatgtcctcccagttcaaggacctcaaagtgaacctgagtgcccagtctctgctgcacgatggcagccccctgtccccattctggcaggacacagcgttcatcacactctctcctaaagaagcaaagacctacccctgcaaaatctcctattcccagtacagccagtacctgtcaacagacaagctgatccgcatcagtgccctgggtgaagagaaaagcagtcctgagaaaatcctggtgaacaagatcatcaccttatcttatccaagcatcacgattaatgttctaggagcagccgttgtgaaccagccactctccatacaggtgatattttcaaaccccctctcggagcaggttgaggactgtgtgctgactgtggaaggaagtggcctcttcaagaaacagcagaaagtcttccttggagtcctcaaaccccaacaccaagcaagcatcattctggagaccgtccccttcaagagtggacaaaggcagatccaagctaatatgagaagcaacaagtttaaggacattaagggttacaggaatgtttatgtagactttgcattataaattctggaacaacgcgccagacgtgtgaatttc

SEQ ID NO: 61 - DNA, 1216 bp, Homo sapiens
ggatccggaagcacaggagaccaagagaccagagataccaggatgagagataggacccctggttgccaggttcgagaagtcctaggctgagtccctggaaatggtcgcacttggagggtctcgccgccagtggaaggagccaccgcccccgcccgaccatggccgaggagctggtcttagagaggtgtgatctggagctggagaccaatggccgagaccaccacacggccgacctgtgccgggagaagctggtggtgcgacggggccagcccttctggctgaccctgcactttgagggccgcaactacgaggccagtgtagacagtctcaccttcagtgtcgtgaccggcccagcccctagccaggaggccgggaccaaggcccgttttccactaagagatgctgtggaggagggtgactggacagccaccgtggtggaccagcaagactgcaccctctcgctgcagctcaccaccccggccaacgcccccatcggcctgtatcgcctcagcctggaggcctccactggctaccagggatccagctttgtgctgggccacttcattttgctcttcaacgcctggtgcccagcggatgctgtgtacctggactcggaagaggagcggcaggagtatgtcctcacccagcagggctttatctaccagggctcggccaagttcatcaagaacataccttggaattttgggcagtttgaagatgggatcctagacatctgcctgatccttctagatgtcaaccccaagttcctgaagaacgccggccgtgactgctcccgccgcagcagccccgtctacgtgggccgggtggtgagtggcatggtcaactgcaacgatgaccagggtgtgctgctgggacgctgggacaacaactacggggacggcgtcagccccatgtcctggatcggcagcgtggacatcctgcggcgctggaagaaccacggctgccagcgcgtcaagtatggccagtgctgggtcttcgccgccgtggcctgcacaggtgagctgcacgctgggatgtgggtcatgagccctgggagggggcacgaagagcactggagtaggaatcaggacatccctgccctggtcctgccccctgccaccaacactctcaatgcgctatgtggcctagagcctgtgaccaccctctccggtcctttatccaatagccatccctccagtggttgttaggatcaagg

SEQ ID NO: 62 - DNA, 1947 bp, Homo sapiens
attgcagggctagaagtggccctcacagacctccagagctccagaaataatgtgcggcaccacacggaggagatcactgtggaccacctgcttgttcgccggggccaggccttcaacctcaccctgtacttcaggaaccggagcttccagccaggcctggacaacatcatcttcgtggttgaaactgaggatgctgtctacttggacagtgaaccccagaggcaggagtatgtcatgaatgattatggcttcatctaccaaggcagcaagaactggatccgcccatgtccctggaactatggacagtttgaagacaaaatcatagacatctgcctgaagctgctagacaagagcctgcacttccagactgacccagccacagactgtgctctgcggggaagccccgtctacgtcagcagagtggtgtgtgccatgatcaacagcaatgatgataatggggtgctcaatggaaactggagtgagaattacacagacggcgccaaccctgcggagtggacgggcagcgtggccatcctgaagcagtggaacgccacaggctgccagcccgtgcgctacgggcaatgctgggtctttgctgccgtcatgtgcacagtgatgaggtgtctggggatccctacccgtgtgatcaccaacttcgactctggccacgatacagatggaaacctgatcatagatgagtattatgacaacacaggcaggattttggggaataagaagaaggatactatctggaacttccatgtctggaatgagtgctggatggcccggaaggatctgccccctgcatatggaggctggcaggtgctggacgccacacctcaggagatgagcaacggcgtctactgctgtggccctgcctctgtcagagccatcaaagaaggagaagtggacctgaactatgacacgccctttgtgttttcgatggtgaatgctgactgcatgtcctggctcgtccagggagggaaggagcagaagcttcaccaggacacgagttctgttggcaattttatcagcacaaagagcatccagagtgacgagcgggatgacatcacagagaactacaagtatgaagaaggatccctccaggagaggcaggtgtttctgaaggctctgcagaagctgaaggctagaagcttccatggctcccaaagaggagcagagttgcaaccttccaggcccacatcactgagccaggacagccctcggagcctgcatacaccttcccttcgacccagtgatgtggtgcaagtctccctgaaattcaagctgctcgacccgcccaacatgggccaggatatatgctttgtcctgctggccctcaacatgtcctcccagttcaaggacctcaaagtgaacctgagtgcccagtctctgctgcacgatggcagccccctgtccccattctggcaggacacagcgttcatcacactctctcctaaagaagcaaagacctacccctgcaaaatctcctattcccagtacagccagtacctgtcaacagacaagctgatccgcatcagtgccctgggtgaagagaaaagcagtcctgagaaaatcctggtgaacaagatcatcaccttatcttatccaagcatcacgattaatgttctaggagcagccgttgtgaaccagccactctccatacaggtgatattttcaaaccccctctcggagcaggttgaggactgtgtgctgactgtggaaggaagtggcctcttcaagaaacagcagaaagtcttccttggagtcctcaaaccccaacaccaagcaagcatcattctggagaccgtccccttcaagagtggacaaaggcagatccaagctaatatgagaagcaacaagtttaaggacattaagggttacaggaatgtttatgtagactttgcattataaattctggaacaacgcgccagacgtgtgaatttc

SEQ ID NO: 63 - DNA, 2154 bp, Homo sapiens
gggctagaagtggccctcacagacctccagagctccagaaataatgtgcggcaccacacggaggagatcactgtggaccacctgcttgttcgccggggccaggccttcaacctcaccctgtacttcaggaaccggagcttccagccaggcctggacaacatcatcttcgtggttgaaactggaccgctgccagacctggccttggggactcgggctgtgttcagcctggcacgccatcacagccccagcccctggattgcctggctggagaccaatggggccacctccacagaggtgagcttgtgcgctcctcccacggcggccgtgggtcggtacctcttgaaaatccacatcgactccttccaggggtctgtgacggcctaccagctaggggagttcatcctgcttttcaatccctggtgcccagaggatgctgtctacttggacagtgaaccccagaggcaggagtatgtcatgaatgattatggcttcatctaccaaggcagcaagaactggatccgcccatgtccctggaactatggacagtttgaagacaaaatcatagacatctgcctgaagctgctagacaagagcctgcacttccagactgacccagccacagactgtgctctgcggggaagccccgtctacgtcagcagagtggtgtgtgccatgatcaacagcaatgatgataatggggtgctcaatggaaactggagtgagaattacacagacggcgccaaccctgcggagtggacgggcagcgtggccatcctgaagcagtggaacgccacaggctgccagcccgtgcgctacgggcaatgctgggtctttgctgccgtcatgtgcacagtgatgaggtgtctggggatccctacccgtgtgatcaccaacttcgactctggccacgatacagatggaaacctgatcatagatgagtattatgacaacacaggcaggattttggggaataagaagaaggatactatctggaacttccatgtctggaatgagtgctggatggcccggaaggatctgccccctgcatatggaggctggcaggtgctggacgccacacctcaggagatgagcaacggcgtctactgctgtggccctgcctctgtcagagccatcaaagaaggagaagtggacctgaactatgacacgccctttgtgttttcgatggtgaatgctgactgcatgtcctggctcgtccagggagggaaggagcagaagcttcaccaggacacgagttctgttggcaattttatcagcacaaagagcatccagagtgacgagcgggatgacatcacagagaactacaagtatgaagaaggatccctccaggagaggcaggtgtttctgaaggctctgcagaagctgaaggctagaagcttccatggctcccaaagaggagcagagttgcaaccttccaggcccacatcactgagccaggacagccctcggagcctgcatacaccttcccttcgacccagtgatgtggtgcaagtctccctgaaattcaagctgctcgacccgcccaacatgggccaggatatatgctttgtcctgctggccctcaacatgtcctcccagttcaaggacctcaaagtgaacctgagtgcccagtctctgctgcacgatggcagccccctgtccccattctggcaggacacagcgttcatcacactctctcctaaagaagcaaagacctacccctgcaaaatctcctattcccagtacagccagtacctgtcaacagacaagctgatccgcatcagtgccctgggtgaagagaaaagcagtcctgagaaaatcctggtgaacaagatcatcaccttatcttatccaagcatcacgattaatgtaggcaggagagcagccgttgtgaaccagccactctccatacaggtgatattttcaaaccccctctcggagcaggttgaggactgtgtgctgactgtggaaggaagtggcctcttcaagaaacagcagaaagtcttccttggagtcctcaaaccccaacaccaagcaagcatcattctggagaccgtccccttcaagagtggacaaaggcagatccaagctaatatgagaagcaacaagtttaaggacattaagggttacaggaatgtttatgtagactttgcatta

SEQ ID NO: 64 - DNA, 3613 bp, Homo sapiens
ggatccggaagcacaggagaccaagagaccagagataccaggatgagagataggacccctggttgccaggttcgagaagtcctaggctgagtccctggaaatggtcgcacttggagggtctcgccgccagtggaaggagccaccgcccccgcccgaccatggccgaggagctggtcttagagaggtgtgatctggagctggagaccaatggccgagaccaccacacggccgacctgtgccgggagaagctggtggtgcgacggggccagcccttctggctgaccctgcactttgagggccgcaactacgaggccagtgtagacagtctcaccttcagtgtcgtgaccggcccagcccctagccaggaggccgggaccaaggcccgttttccactaagagatgctgtggaggagggtgactggacagccaccgtggtggaccagcaagactgcaccctctcgctgcagctcaccaccccggccaacgcccccatcggcctgtatcgcctcagcctggaggcctccactggctaccagggatccagctttgtgctgggccacttcattttgctcttcaacgcctggtgcccagcggatgctgtgtacctggactcggaagaggagcggcaggagtatgtcctcacccagcagggctttatctaccagggctcggccaagttcatcaagaacataccttggaattttgggcagtttgaagatgggatcctagacatctgcctgatccttctagatgtcaaccccaagttcctgaagaacgccggccgtgactgctcccgccgcagcagccccgtctacgtgggccgggtggtgagtggcatggtcaactgcaacgatgaccagggtgtgctgctgggacgctgggacaacaactacggggacggcgtcagccccatgtcctggatcggcagcgtggacatcctgcggcgctggaagaaccacggctgccagcgcgtcaagtatggccagtgctgggtcttcgccgccgtggcctgcacagtgctgaggtgcctgggcatccctacccgcgtcgtgaccaactacaactcggcccatgaccagaacagcaaccttctcatcgagtacttccgcaatgagtttggggagatccagggtgacaagagcgagatgatctggaacttccactgctgggtggagtcgtggatgaccaggccggacctgcagccggggtacgagggctggcaggccctggacccaacgccccaggagaagagcgaagggacgtactgctgtggcccagttccagttcgtgccatcaaggagggcgacctgagcaccaagtacgatgcgccctttgtctttgcggaggtcaatgccgacgtggtagactggatccagcaggacgatgggtctgtgcacaaatccatcaaccgttccctgatcgttgggctgaagatcagcactaagagcgtgggccgagacgagcgggaggatatcacccacacctacaaatacccagaggggtcctcagaggagagggaggccttcacaagggcgaaccacctgaacaaactggccgagaaggaggagacagggatggccatgcggatccgtgtgggccagagcatgaacatgggcagtgactttgacgtctttgcccacatcaccaacaacaccgctgaggagtacgtctgccgcctcctgctctgtgcccgcaccgtcagctacaatgggatcttggggcccgagtgtggcaccaagtacctgctcaacctcaacctggagcctttctctgagaagagcgttcctctttgcatcctctatgagaaataccgtgactgccttacggagtccaacctcatcaaggtgcgggccctcctcgtggagccagttatcaacagctacctgctggctgagagggacctctacctggagaatccagaaatcaagatccggatccttggggagcccaagcagaaacgcaagctggtggctgaggtgtccctgcagaacccgctccctgtggccctggaaggctgcaccttcactgtggagggggccggcctgactgaggagcagaagacggtggagatcccagaccccgtggaggcaggggaggaagttaaggtgagaatggacctgctgccgctccacatgggcctccacaagctggtggtgaacttcgagagcgacaagctgaaggctgtgaagggcttccggaatgtcatcattggccccgcctaagggacccctgctcccagcctgctgagagcccccaccttgatcccaatccttatcccaagctagtgagcaaaatatgccccttcttgggccccagaccccagggcagggtgggcagcctatgggggctctcggaaatggaatgtgcccctggcccatctcagcctcctgagcctgtgggtccccactcaccccctttgctgtgaggaatgctctgtgccagaaacagtgggagccctgaccttggctgactggggctggggtgagagaggaaagacctacattccctctcctgcccagatgccctttggaaagccattgaccacccaccatattgtttgatctacttcatagctccttggagcaggcaaaaaagggacagcatgccccttggctggatcagggaatccagctccctagactgcatcccgtacctcttcccatgactgcacccagctccaggggcccttgggacagccagagctgggtggggacagtgataggcccaaggtcccctccacatcccagcagcccaagcttaatagccctccccctcaacctcaccattgtgaagcacctactatgtgctgggtgcctcccacacttgctggggctcacggggcctccaacccatttaatcaccatgggaaactgttgtgggcgctgcttccaggataaggagactgaggcttagagagaggaggcagccccctccacaccagtggcctcgtggttattagcaaggctgggtaatgtgaaggcccaagagcagagtctgggcctctgactctgagtccactgctccatttataaccccagcctgacctgagactgtcggagaggctgtctggggcctttatcaaaaaaagactcagccaagacaaggaggtagagaggggactgggggactgggagtcagagccctggctgggttcaggtcccacgtctggccaggcactgccttctcctctctgggcctttgtttccttgttggtcagaggagtgattgaaccagctcatctccaaggatcctctccactccatgtttgcaatgcttttatatggcccagccttgtaaataaccacaaggtccactccctgctccacgaagccttaagccataggcccaggatatttctgagaatcacagcctccagggccccccaaatcccagggaaggacttggagagaatcatgctgttgcatttagaactttctgctttgcacaggaaagagtcacacaattaatcaacatgtatattttctctatacatagagctctatttctctacggttttataaaagccttgggttccaaccaggcagtagatgtgcttctgaaccgcaaggagcaaacactgaaataaaatagtttatttttcacactcaaacta

SEQ ID NO: 65 - DNA, 2217 bp, Homo sapiens
ggatccggaagcacaggagaccaagagaccagagataccaggatgagagataggacccctggttgccaggttcgagaagtcctaggctgagtccctggaaatggtcgcacttggagggtctcgccgccagtggaaggagccaccgcccccgcccgaccatggccgaggagctggtcttagagaggtgtgatctggagctggagaccaatggccgagaccaccacacggccgacctgtgccgggagaagctggtggtgcgacggggccagcccttctggctgaccctgcactttgagggccgcaactacgaggccagtgtagacagtctcaccttcagtgtcgtgaccggcccagcccctagccaggaggccgggaccaaggcccgttttccactaagagatgctgtggaggagggtgactggacagccaccgtggtggaccagcaagactgcaccctctcgctgcagctcaccaccccggccaacgcccccatcggcctgtatcgcctcagcctggaggcctccactggctaccagggatccagctttgtgctgggccacttcattttgctcttcaacgcctggtgcccagcggatgctgtgtacctggactcggaagaggagcggcaggagtatgtcctcacccagcagggctttatctaccagggctcggccaagttcatcaagaacataccttggaattttgggcagtttgaagatgggatcctagacatctgcctgatccttctagatgtcaaccccaagttcctgaagaacgccggccgtgactgctcccgccgcagcagccccgtctacgtgggccgggtggtgagtggcatggtcaactgcaacgatgaccagggtgtgctgctgggacgctgggacaacaactacggggacggcgtcagccccatgtcctggatcggcagcgtggacatcctgcggcgctggaagaaccacggctgccagcgcgtcaagtatggccagtgctgggtcttcgccgccgtggcctgcacagtgctgaggtgcctgggcatccctacccgcgtcgtgaccaactacaactcggcccatgaccagaacagcaaccttctcatcgagtacttccgcaatgagtttggggagatccagggtgacaagagcgagatgatctggaacttccactgctgggtggagtcgtggatgaccaggccggacctgcagccggggtacgagggctggcaggccctggacccaacgccccaggagaagagcgaagggacgtactgctgtggcccagttccagttcgtgccatcaaggagggcgacctgagcaccaagtacgatgcgccctttgtctttgcggaggtcaatgccgacgtggtagactggatccagcaggacgatgggtctgtgcacaaatccatcaaccgttccctgatcgttgggctgaagatcagcactaagagcgtgggccgagacgagcgggaggatatcacccacacctacaaatacccagaggggtcctcagaggagagggaggccttcacaagggcgaaccacctgaacaaactggccgagaaggaggagacagggatggccatgcggatccgtgtgggccagagcatgaacatgggcagtgactttgacgtctttgcccacatcaccaacaacaccgctgaggagtacgtctgccgcctcctgctctgtgcccgcaccgtcagctacaatgggatcttggggcccgagtgtggcaccaagtacctgctcaacctcaacctggagcctttctctggtaaagccctgtgttcctggagcatttgttgaccgccaactgacaacatgctaggtagtgacctaaccacttagcatgtgtgatttcaccccacagacacttacatggcgctgactctggggcaggccctgtcctaagcactttataaatatcaacccacttaattcttattgcaagatgaggctggtccaagtcccctgttggaacctccaatgccaagctcaagctgagatgcgttccctctaagcccccatactgtggttgagttacttgttattctttgatgataagatctggggaatttccgtgtgctggtggacaggaagccaggccctggatggctgaaaggaatccagttgcccccacccctgcctcctttctctgctgcttctttctcttctccttcctgcctccaccctttcatgctctctcctccctcatccc

SEQ ID NO: 66 - DNA, 2217 bp, Homo sapiens; identical to SEQ ID NO: 65

SEQ ID NO: 67 - DNA, 3937 bp, Homo sapiens
ataagttagcgccgctctccgcctcggcagtgccagccgccagtggtcgcacttggagggtctcgccgccagtggaaggagccaccgcccccgcccgaccatggccgaggagctggtcttagagaggtgtgatctggagctggagaccaatggccgagaccaccacacggccgacctgtgccgggagaagctggtggtgcgacggggccagcccttctggctgaccctgcactttgagggccgcaactacgaggccagtgtagacagtctcaccttcagtgtcgtgaccggcccagcccctagccaggaggccgggaccaaggcccgttttccactaagagatgctgtggaggagggtgactggacagccaccgtggtggaccagcaagactgcaccctctcgctgcagctcaccaccccggccaacgcccccatcggcctgtatcgcctcagcctggaggcctccactggctaccagggatccagctttgtgctgggccacttcattttgctcttcaacgcctggtgcccagcggatgctgtgtacctggactcggaagaggagcggcaggagtatgtcctcacccagcagggctttatctaccagggctcggccaagttcatcaagaacataccttggaattttgggcagtttgaagatgggatcctagacatctgcctgatccttctagatgtcaaccccaagttcctgaagaacgccggccgtgactgctcccgccgcagcagccccgtctacgtgggccgggtggtgagtggcatggtcaactgcaacgatgaccagggtgtgctgctgggacgctgggacaacaactacggggacggcgtcagccccatgtcctggatcggcagcgtggacatcctgcggcgctggaagaaccacggctgccagcgcgtcaagtatggccagtgctgggtcttcgccgccgtggcctgcacagtgctgaggtgcctgggcatccctacccgcgtcgtgaccaactacaactcggcccatgaccagaacagcaaccttctcatcgagtacttccgcaatgagtttggggagatccagggtgacaagagcgagatgatctggaacttccactgctgggtggagtcgtggatgaccaggccggacctgcagccggggtacgagggctggcaggccctggacccaacgccccaggagaagagcgaagggacgtactgctgtggcccagttccagttcgtgccatcaaggagggcgacctgagcaccaagtacgatgcgccctttgtctttgcggaggtcaatgccgacgtggtagactggatccagcaggacgatgggtctgtgcacaaatccatcaaccgttccctgatcgttgggctgaagatcagcactaagagcgtgggccgagacgagcgggaggatatcacccacacctacaaatacccagaggggtcctcagaggagagggaggccttcacaagggcgaaccacctgaacaaactggccgagaaggaggagacagggatggccatgcggatccgtgtgggccagagcatgaacatgggcagtgactttgacgtctttgcccacatcaccaacaacaccgctgaggagtacgtctgccgcctcctgctctgtgcccgcaccgtcagctacaatgggatcttggggcccgagtgtggcaccaagtacctgctcaacctcaacctggagcctttctctgagaagagcgttcctctttgcatcctctatgagaaataccgtgactgccttacggagtccaacctcatcaaggtgcgggccctcctcgtggagccagttatcaacagctacctgctggctgagagggacctctacctggagaatccagaaatcaagatccggatccttggggagcccaagcagaaacgcaagctggtggctgaggtgtccctgcagaacccgctccctgtggccctggaaggctgcaccttcactgtggagggggccggcctgactgaggagcagaagacggtggagatcccagaccccgtggaggcaggggaggaagttaaggtgagaatggacctgctgccgctccacatgggcctccacaagctggtggtgaacttcgagagcgacaagctgaaggctgtgaagggcttccggaatgtcatcattggccccgcctaagggacccctgctcccagcctgctgagagcccccaccttgatcccaatccttatcccaagctagtgagcaaaatatgccccttcttgggccccagaccccagggcagggtgggcagcctatgggggctctcggaaatggaatgtgcccctggcccatctcagcctcctgagcctgtgggtccccactcaccccctttgctgtgaggaatgctctgtgccagaaacagtgggagccctgaccttggctgactggggctggggtgagagaggaaagacctacattccctctcctgcccagatgccctttggaaagccattgaccacccaccatattgtttgatctacttcatagctccttggagcaggcaaaaaagggacagcatgccccttggctggatcagggaatccagctccctagactgcatcccgtacctcttcccatgactgcacccagctccaggggcccttgggacagccagagctgggtggggacagtgataggcccaaggtcccctccacatcccagcagcccaagcttaatagccctccccctcaacctcaccattgtgaagcacctactatgtgctgggtgcctcccacacttgctggggctcacggggcctccaacccatttaatcaccatgggaaactgttgtgggcgctgcttccaggataaggagactgaggcttagagagaggaggcagccccctccacaccagtggcctcgtggttattagcaaggctgggtaatgtgaaggcccaagagcagagtctgggcctctgactctgagtccactgctccatttataaccccagcctgacctgagactgtcggagaggctgtctggggcctttatcaaaaaaagactcagccaagacaaggaggtagagaggggactgggggactgggagtcagagccctggctgggttcaggtcccacgtctggccaggcactgccttctcctctctgggcctttgtttccttgttggtcagaggagtgattgaaccagctcatctccaaggatcctctccactccatgtttgcaatgcttttatatggcccagccttgtaaataaccacaaggtccactccctgctccacgaagccttaagccataggcccaggatatttctgagagtgaaaccatgactgtgaccaccttctgtccccagccctgtcctggttccttcctatgcccaggtaccacccttcagaccccagttctaggggagaagagccctggacacccctgctctacccatgagcctgcccgctgcaatgcctagacttcccaacagccttagctgccagtgctggtcactaaccaacaaggttggcaccccagctaccccttctttgcagggctaaggcccccaaacatagcccctgccccggaggaagcttggggaacccatgagttgtcagctttgactttatctcctgctctttctacatgactgggcctcccttgggctggaagaattggggattctctattggaggtgagatcacagcctccagggccccccaaatcccagggaaggacttggagagaatcatgctgttgcatttagaactttctgctttgcacaggaaagagtcacacaattaatcaacatgtatattttctctatacatagagctctatttctctacggttttataaaagccttgggttccaaccaggcagtagatgtgcttctgaaccgcaaggagcaaacactgaaataaaatagtttatttttcacactcaaaaaaaaaaaaaaaaaa

SEQ ID NO: 68 - DNA, 2202 bp, Homo sapiens; identical to SEQ ID NO: 60

SEQ ID NO: 69 - protein, 686 aa, Homo sapiens
KDSMFGIAVKNIGDINQDGYPDIAVGAPYDDLGKVFIYHGSANGINTKPTQVLKGISPYFGYSIAGNMDLDRNSYPDVAVGSLSDSVTIFRSRPVINIQKTITVTPNRIDLRQKTACGAPSGICLQVKSCFEYTANPAGYNPSISIVGTLEAEKERRKSGLSSRVQFRNQGSEPKYTQELTLKRQKQKVCMEETLWLQDNIRDKLRPIPITASVEIQEPSSRRRVNSLPEVLPILNSDEPKTAHIDVHFLKEGCGDDNVCNSNLKLEYKFCTREGNQDKFSYLPIQKGVPELVLKDQKDIALEITVTNSPSNPRNPTKDGDDAHEAKLIATFPDTLTYSAYRELRAFPEKQLSCVANQNGSQADCELGNPFKRNSNVTFYLVLSTTEVTFDTPDLDINLKLETTSNQDNLAPITAKAKVVIELLLSVSGVAKPSQVYFGGTVVGEQAMKSEDEVGSLIEYEFRVINLGKPLTNLGTATLNIQWPKEISNGKWLLYLVKVESKGLEKESHNSRKKREITEKQIDDNRKFSLFAERKYQTLNCSVNVNCVNIRCPLRGLDSKASLILRSRLWNSTFLEEYSKLNYLDILMRAFIDVTAAAENIRLPNAGTQVRVTVFPSKTVAQYSGVPWWIILVAILAGILMLALLVFILWKCGFFKRNKKDHYDATYHKAEIHAQPSDKERLTSDA

SEQ ID NO: 70 - protein, 1091 aa, Homo sapiens
MAAAGQLCLLYLSAGLLSRLGAAFNLDTREDNVIRKYGDPGSLFGFSLAMHWQLQPEDKRLLLVGAPRAEALPLQRANRTGGLYSCDITARGPCTRIEFDNDADPTSESKEDQWMGVTVQSQGPGGKVVTCAHRYEKRQHVNTKQESRDIFGRCYVLSQNLRIEDDMDGGDWSFCDGRLRGHEKFGSCQQGVAATFTKDFHYIVFGAPGTYNWKGIVRVEQKNNTFFDMNIFEDGPYEVGGETEHDESLVPVPANSYLGFSLDSGKGIVSKDEITFVSGAPRANHSGAVVLLKRDMKSAHLLPEHIFDGEGLASSFGYDVAVVDLNKDGWQDIVIGAPQYFDRDGEVGGAVYVYMNQQGRWNNVKPIRLNGTKDSMFGIAVKNIGDINQDGYPDIAVGAPYDDLGKVFIYHGSANGINTKPTQVLKGISPYFGYSIAGNMDLDRNSYPDVAVGSLSDSVTIFRSRPVINIQKTITVTPNRIDLRQKTACGAPSGICLQVKSCFEYTANPAGYNPSISIVGTLEAEKERRKSGLSSRVQFRNQGSEPKYTQELTLKRQKQKVCMEETLWLQDNIRDKLRPIPITASVEIQEPSSRRRVNSLPEVLPILNSDEPKTAHIDVHFLKEGCGDDNVCNSNLKLEYKFCTREGNQDKFSYLPIQKGVPELVLKDQKDIALEITVTNSPSNPRNPTKDGDDAHEAKLIATFPDTLTYSAYRELRAFPEKQLSCVANQNGSQADCELGNPFKRNSNVTFYLVLSTTEVTFDTPDLDINLKLETTSNQDNLAPITAKAKVVIELLLSVSGVAKPSQVYFGGTVVGEQAMKSEDEVGSLIEYEFRVINLGKPLTNLGTATLNIQWPKEISNGKWLLYLVKVESKGLEKVTCEPQKEINSLNLTESHNSRKKREITEKQIDDNRKFSLFAERKYQTLNCSVNVNCVNIRCPLRGLDSKASLILRSRLWNSTFLEEYSKLNYLDILMRAFIDVTAAAENIRLPNAGTQVRVTVFPSKTVAQYSGVPWWIILVAILAGILMLALLVFILWKCGFFKRSRYDDSVPRYHAVRIRKEEREIKDEKYIDNLEKKQWITKWNENESYS

SEQ ID NO: 71 - protein, 1130 aa, Homo sapiens
MAAAGQLCLLYLSAGLLSRLGAAFNLDTREDNVIRKYGDPGSLFGFSLAMHWQLQPEDKRLLLVGAPRGEALPLQRANRTGGLYSCDITARGPCTRIEFDNDADPTSESKEDQWMGVTVQSQGPGGKVVTCAHRYEKRQHVNTKQESRDIFGRCYVLSQNLRIEDDMDGGDWSFCDGRLRGHEKFGSCQQGVAATFTKDFHYIVFGAPGTYNWKGIVRVEQKNNTFFDMNIFEDGPYEVGGETEHDESLVPVPANSYLGLLFLTSVSYTDPDQFVYKTRPPREQPDTFPDVMMNSYLGFSLDSGKGIVSKDEITFVSGAPRANHSGAVVLLKRDMKSAHLLPEHIFDGEGLASSFGYDVAVVDLNKDGWQDIVIGAPQYFDRDGEVGGAVYVYMNQQGRWNNVKPIRLNGTKDSMFGIAVKNIGDINQDGYPDIAVGAPYDDLGKVFIYHGSANGINTKPTQVLKGISPYFGYSIAGNMDLDRNSYPDVAVGSLSDSVTIFRSRPVINIQKTITVTPNRIDLRQKTACGAPSGICLQVKSCFEYTANPAGYNPSISIVGTLEAEKERRKSGLSSRVQFRNQGSEPKYTQELTLKRQKQKVCMEETLWLQDNIRDKLRPIPITASVEIQEPSSRRRVNSLPEVLPILNSDEPKTAHIDVHFLKEGCGDDNVCNSNLKLEYKFCTREGNQDKFSYLPIQKGVPELVLKDQKDIALEITVTNSPSNPRNPTKDGDDAHEAKLIATFPDTLTYSAYRELRAFPEKQLSCVANQNGSQADCELGNPFKRNSNVTFYLVLSTTEVTFDTPDLDINLKLETTSNQDNLAPITAKAKVVIELLLSVSGVAKPSQVYFGGTVVGEQAMKSEDEVGSLIEYEFRVINLGKPLTNLGTATLNIQWPKEISNGKWLLYLVKVESKGLEKVTCEPQKEINSLNLTESHNSRKKREITEKQIDDNRKFSLFAERKYQTLNCSVNVNCVNIRCPLRGLDSKASLILRSRLWNSTFLEEYSKLNYLDILMRAFIDVTAAAENIRLPNAGTQVRVTVFPSKTVAQYSGVPWWIILVAILAGILMLALLVFILWKCGFFKRSRYDDSVPRYHAVRIRKEEREIKDEKYIDNLEKKQWITKWNRNESYS

SEQ ID NO: 72 - protein, 1073 aa, Homo sapiens
MAAAGQLCLLYLSAGLLSRLGAAFNLDTREDNVIRKYGDPGSLFGFSLAMHWQLQPEDKRLLLVGAPRGEALPLQRANRTGGLYSCDITARGPCTRIEFDNDADPTSESKEDQWMGVTVQSQGPGGKVVTCAHRYEKRQHVNTKQESRDIFGRCYVLSQNLRIEDDMDGGDWSFCDGRLRGHEKFGSCQQGVAATFTKDFHYIVFGAPGTYNWKGIVRVEQKNNTFFDMNIFEDGPYEVGGETEHDESLVPVPANSYLGFSLDSGKGIVSKDEITFVSGAPRANHSGAVVLLKRDMKSAHLLPEHIFDGEGLASSFGYDVAVVDLNKDGWQDIVIGAPQYFDRDGEVGGAVYVYMNQQGRWNNVKPIRLNGTKDSMFGIAVKNIGDINQDGYPDIAVGAPYDDLGKVFIYHGSANGINTKPTQVLKGISPYFGYSIAGNMDLDRNSYPDVAVGSLSDSVTIFRSRPVINIQKTITVTPNRIDLRQKTACGAPSGICLQVKSCFEYTANPAGYNPSISIVGTLEAEKERRKSGLSSRVQFRNQGSEPKYTQELTLKRQKQKVCMEETLWLQDNIRDKLRPIPITASVEIQEPSSRRRVNSLPEVLPILNSDEPKTAHIDVHFLKEGCGDDNVCNSNLKLEYKFCTREGNQDKFSYLPIQKGVPELVLKDQKDIALEITVTNSPSNPRNPTKDGDDAHEAKLIATFPDTLTYSAYRELRAFPEKQLSCVANQNGSQADCELGNPFKRNSNVTFYLVLSTTEVTFDTPYLDINLKLETTSNQDNLAPITAKAKVVIELLLSVSGVAKPSQVYFGGTVVGEQAMKSEDEVGSLIEYEFRVINLGKPLTNLGTATLNIQWPKEISNGKWLLYLVKVESKGLEKVTCEPQKEINSLNLTESHNSRKKREITEKQIDDNRKFSLFAERKYQTLNCSVNVNCVNIRCPLRGLDSKASLILRSRLWNSTFLEEYSKLNYLDILMRAFIDVTAAAENIRLPNAGTQVRVTVFPSKTVAQYSGVPWWIILVAILAGILMLALLVFILWKCGFFKRNKKDHYDATYHKAEIHAQPSDKERLTSDA

SEQ ID NO: 73 - protein, 1130 aa, Homo sapiens
MAAAGQLCLLYLSAGLLSRLGAAFNLDTREDNVIRKYGDPGSLFGFSLAMHWQLQPEDKRLLLVGAPRAEALPLQRANRTGGLYSCDITARGPCTRIEFDNDADPTSESKEDQWMGVTVQSQGPGGKVVTCAHRYEKRQHVNTKQESRDIFGRCYVLSQNLRIEDDMDGGDWSFCDGRLRGHEKFGSCQQGVAATFTKDFHYIVFGAPGTYNWKGIVRVEQKNNTFFDMNIFEDGPYEVGGETEHDESLVPVPANSYLGLLFLTSVSYTDPDQFVYKTRPPREQPDTFPDVMMNSYLGFSLDSGKGIVSKDEITFVSGAPRANHSGAVVLLKRDMKSAHLLPEHIFDGEGLASSFGYDVAVVDLNKDGWQDIVIGAPQYFDRDGEVGGAVYVYMNQQGRWNNVKPIRLNGTKDSMFGIAVKNIGDINQDGYPDIAVGAPYDDLGKVFIYHGSANGINTKPTQVLKGISPYFGYSIAGNMDLDRNSYPDVAVGSLSDSVTIFRSRPVINIQKTITVTPNRIDLRQKTACGAPSGICLQVKSCFEYTANPAGYNPSISIVGTLEAEKERRKSGLSSRVQFRNQGSEPKYTQELTLKRQKQKVCMEETLWLQDNIRDKLRPIPITASVEIQEPSSRRRVNSLPEVLPILNSDEPKTAHIDVHFLKEGCGDDNVCNSNLKLEYKFCTREGNQDKFSYLPIQKGVPELVLKDQKDIALEITVTNSPSNPRNPTKDGDDAHEAKLIATFPDTLTYSAYRELRAFPEKQLSCVANQNGSQADCELGNPFKRNSNVTFYLVLSTTEVTFDTPDLDINLKLETTSNQDNLAPITAKAKVVIELLLSVSGVAKPSQVYFGGTVVGEQAMKSEDEVGSLIEYEFRVINLGKPLTNLGTATLNIQWPKEISNGKWLLYLVKVESKGLEKVTCEPQKEINSLNLTESHNSRKKREITEKQIDDNRKFSLFAERKYQTLNCSVNVNCVNIRCPLRGLDSKASLILRSRLWNSTFLEEYSKLNYLDILMRAFIDVTAAAENIRLPNAGTQVRVTVFPSKTVAQYSGVPWWIILVAILAGILMLALLVFILWKCGFFKRSRYDDSVPRYHAVRIRKEEREIKDEKYIDNLEKKQWITKWNENESYS

SEQ ID NO: 74 - protein, 1073 aa, Homo sapiens
MAAAGQLCLLYLSAGLLSRLGAAFNLDTREDNVIRKYGDPGSLFGFSLAMHWQLQPEDKRLLLVGAPRAEALPLQRANRTGGLYSCDITARGPCTRIEFDNDADPTSESKEDQWMGVTVQSQGPGGKVVTCAHRYEKRQHVNTKQESRDIFGRCYVLSQNLRIEDDMDGGDWSFCDGRLRGHEKFGSCQQGVAATFTKDFHYIVFGAPGTYNWKGIVRVEQKNNTFFDMNIFEDGPYEVGGETEHDESLVPVPANSYLGFSLDSGKGIVSKDEITFVSGAPRANHSGAVVLLKRDMKSAHLLPEHIFDGEGLASSFGYDVAVVDLNKDGWQDIVIGAPQYFDRDGEVGGAVYVYMNQQGRWNNVKPIRLNGTKDSMFGIAVKNIGDINQDGYPDIAVGAPYDDLGKVFIYHGSANGINTKPTQVLKGISPYFGYSIAGNMDLDRNSYPDVAVGSLSDSVTIFRSRPVINIQKTITVTPNRIDLRQKTACGAPSGICLQVKSCFEYTANPAGYNPSISIVGTLEAEKERRKSGLSSRVQFRNQGSEPKYTQELTLKRQKQKVCMEETLWLQDNIRDKLRPIPITASVEIQEPSSRRRVNSLPEVLPILNSDEPKTAHIDVHFLKEGCGDDNVCNSNLKLEYKFCTREGNQDKFSYLPIQKGVPELVLKDQKDIALEITVTNSPSNPRNPTKDGDDAHEAKLIATFPDTLTYSAYRELRAFPEKQLSCVANQNGSQADCELGNPFKRNSNVTFYLVLSTTEVTFDTPDLDINLKLETTSNQDNLAPITAKAKVVIELLLSVSGVAKPSQVYFGGTVVGEQAMKSEDEVGSLIEYEFRVINLGKPLTNLGTATLNIQWPKEISNGKWLLYLVKVESKGLEKVTCEPQKEINSLNLTESHNSRKKREITEKQIDDNRKFSLFAERKYQTLNCSVNVNCVNIRCPLRGLDSKASLILRSRLWNSTFLEEYSKLNYLDILMRAFIDVTAAAENIRLPNAGTQVRVTVFPSKTVAQYSGVPWWIILVAILAGILMLALLVFILWKCGFFKRNKKDHYDATYHKAEIHAQPSDKERLTSDA

SEQ ID NO: 75 - DNA, 5476 bp, Homo sapiens
gcggccgctgcaggtccccgctcccctccccgtgcgtccgcccatggccgccgccgggcagctgtgcttgctctacctgtcggcggggctcctgtcccggctcggcgcagccttcaacttggacactcgggaggacaacgtgatccggaaatatggagaccccgggagcctcttcggcttctcgctggccatgcactggcaactgcagcccgaggacaagcggctgttgctcgtgggggccccgcgggcagaagcgcttccactgcagagagccaacagaacgggagggctgtacagctgcgacatcaccgcccgggggccatgcacgcggatcgagtttgataacgatgctgaccccacgtcagaaagcaaggaagatcagtggatgggggtcaccgtccagagccaaggtccagggggcaaggtcgtgacatgtgctcaccgatatgaaaaaaggcagcatgttaatacgaagcaggaatcccgagacatctttgggcggtgttatgtcctgagtcagaatctcaggattgaagacgatatggatgggggagattggagcttttgtgatgggcgattgagaggccatgagaaatttggctcttgccagcaaggtgtagcagctacttttactaaagactttcattacattgtatttggagccccgggtacttataactggaaagggattgttcgtgtagagcaaaagaataacactttttttgacatgaacatctttgaagatgggccttatgaagttggtggagagactgagcatgatgaaagtctcgttcctgttcctgctaacagttacttaggtttttctttggactcagggaaaggtattgtttctaaagatgagatcacttttgtatctggtgctcccagagccaatcacagtggagccgtggttttgctgaagagagacatgaagtctgcacatctcctccctgagcacatattcgatggagaaggtctggcctcttcatttggctatgatgtggcggtggtggacctcaacaaggatgggtggcaagatatagttattggagccccacagtattttgatagagatggagaagttggaggtgcagtgtatgtctacatgaaccagcaaggcagatggaataatgtgaagccaattcgtcttaatggaaccaaagattctatgtttggcattgcagtaaaaaatattggagatattaatcaagatggctacccagatattgcagttggagctccgtatgatgacttgggaaaggtttttatctatcatggatctgcaaatggaataaataccaaaccaacacaggttctcaagggtatatcaccttattttggatattcaattgctggaaacatggaccttgatcgaaattcctaccctgatgttgctgttggttccctctcagattcagtaactattttcagatcccggcctgtgattaatattcagaaaaccatcacagtaactcctaacagaattgacctccgccagaaaacagcgtgtggggcgcctagtgggatatgcctccaggttaaatcctgttttgaatatactgctaaccccgctggttataatccttcaatatcaattgtgggcacacttgaagctgaaaaagaaagaagaaaatctgggctatcctcaagagttcagtttcgaaaccaaggttctgagcccaaatatactcaagaactaactctgaagaggcagaaacagaaagtgtgcatggaggaaaccctgtggctacaggataatatcagagataaactgcgtcccattcccataactgcctcagtggagatccaagagccaagctctcgtaggcgagtgaattcacttccagaagttcttccaattctgaattcagatgaacccaagacagctcatattgatgttcacttcttaaaagagggatgtggagacgacaatgtatgtaacagcaaccttaaactagaatataaattttgcacccgagaaggaaatcaagacaaattttcttatttaccaattcaaaaaggtgtaccagaactagttctaaaagatcagaaggatattgctttagaaataacagtgacaaacagcccttccaacccaaggaatcccacaaaagatggcgatgacgcccatgaggctaaactgattgcaacgtttccagacactttaacctattctgcatatagagaactgagggctttccctgagaaacagttgagttgtgttgccaaccagaatggctcgcaagctgactgtgagctcggaaatccttttaaaagaaattcaaatgtcactttttatttggttttaagtacaactgaagtcacctttgacaccccagatctggatattaatctgaagttagaaacaacaagcaatcaagataatttggctccaattacagctaaagcaaaagtggttattgaactgcttttatcggtctcgggagttgctaaaccttcccaggtgtattttggaggtacagttgttggcgagcaagctatgaaatctgaagatgaagtgggaagtttaatagagtatgaattcagggtaataaacttaggtaaacctcttacaaacctcggcacagcaaccttgaacattcagtggccaaaagaaattagcaatgggaaatggttgctttatttggtgaaagtagaatccaaaggattggaaaaggtaacttgtgagccacaaaaggagataaactccctgaacctaacggagtctcacaactcaagaaagaaacgggaaattactgaaaaacagatagatgataacagaaaattttctttatttgctgaaagaaaataccagactcttaactgtagcgtgaacgtgaactgtgtgaacatcagatgcccgctgcgggggctggacagcaaggcgtctcttattttgcgctcgaggttatggaacagcacatttctagaggaatattccaaactgaactacttggacattctcatgcgagccttcattgatgtgactgctgctgccgaaaatatcaggctgccaaatgcaggcactcaggttcgagtgactgtgtttccctcaaagactgtagctcagtattcgggagtaccttggtggatcatcctagtggctattctcgctgggatcttgatgcttgctttattagtgtttatactatggaagtgtggtttcttcaagagaaataagaaagatcattatgatgccacatatcacaaggctgagatccatgctcagccatctgataaagagaggcttacttctgatgcatagtattgatctacttctgtaattgtgtggattctttaaacgctctaggtacgatgacagtgttccccgataccatgctgtaaggatccggaaagaagagcgagagatcaaagatgaaaagtatattgataaccttgaaaaaaaacagtggatcacaaagtggaacgaaaatgaaagctactcatagcgggggcctaaaaaaaaaaagcttcacagtacccaaactgctttttccaactcagaaattcaatttggatttaaaagcctgctcaatccctgaggactgatttcagagtgactacacacagtacgaacctacagttttaactgtggatattgttacgtagcctaaggctcctgttttgcacagccaaatttaaaactgttggaatggatttttctttaactgccgtaatttaactttctgggttgcctttatttttggcgtggctgacttacatcatgtgttggggaagggcctgcccagttgcactcaggtgacatcctccagatagtgtagctgaggaggcacctacactcacctgcactaacagagtggccgtcctaacctcgggcctgctgcgcagacgtccatcacgttagctgtcccacatcacaagactatgccattggggtagttgtgtttcaacggaaagtgctgtcttaaactaaatgtgcaatagaaggtgatgttgccatcctaccgtcttttcctgtttcctagctgtgtgaatacctgctcacgtcaaatgcatacaagtttcattctccctttcactaaaacacacaggtgcaacagacttgaatgctagttatacttatttgtatatggtatttattttttcttttctttacaaaccattttgttattgactaacaggccaaagagtctccagtttacccttcaggttggtttaatcaatcagaattagagcatgggaggtcatcactttgacctaaattatttactgcaaaaagaaaatctttataaatgtaccagagagagttgttttaataacttatctataaactataacctctccttcatgacagcctccaccccacaacccaaaaggtttaagaaatagaattataactgtaaagatgtttatttcaggcattggatattttttactttagaagcctgcataatgtttctggatttcatactgtaacattcaggaattcttggagaaaatgggtttattcactgaactctagtgcggtttactcactgctgcaaatactgtatattcaggacttgaaagaaatggtgaatgcctatggtggatccaaactgatccagtataagactactgaatctgctaccaaaacagttaatcagtgagtcgatgttctattttttgttttgtttcctcccctatctgtattcccaaaaattactttggggctaatttaacaagaactttaaattgtgttttaattgtaaaaatggcagggggtggaattattactctatacattcaacagagactgaatagatatgaaagctgattttttttaattaccatgcttcacaatgttaagttatatggggagcaacagcaaacaggtgctaatttgttttggatatagtataagcagtgtctgtgttttgaaagaatagaacacagtttgtagtgccactgttgttttgggggggcttttttcttttcggaaatcttaaaccttaagatactaaggacgttgttttggttgtactttggaattcttagtcacaaaatatattttgtttacaaaaatttctgtaaaacaggttataacagtgtttaaagtctcagtttcttgcttggggaacttgtgtccctaatgtgtttagattgctagattgctaaggagctgatactttgacagtgtttttagacctgtgttactaaaaaaaagatgaatgtcctgaaaagggtgttgggagggtggttcaacaaagaaacaaagatgttatggtgtttagatttatggttgttaaaaatgtcatctcaagtcaagtcactggtctgtttgcatttgatacatttttgtactaactagcattgtaaaattatttcatgattagaaattacctgtggatatttgtataaaagtgtgaaataaattttttataaaagtgttcattgtttcgtaacacagcattgtatatgtgaagcaaactctaaaattataaatgacaacctgaattatctatttcatcaaacc

SEQ ID NO: 76 - DNA, 5346 bp, Homo sapiens
gcggccgctgcaggtccccgctcccctccccgtgcgtccgcccatggccgccgccgggcagctgtgcttgctctacctgtcggcggggctcctgtcccggctcggcgcagccttcaacttggacactcgggaggacaacgtgatccggaaatatggagaccccgggagcctcttcggcttctcgctggccatgcactggcaactgcagcccgaggacaagcggctgttgctcgtgggggccccgcgggcagaagcgcttccactgcagagagccaacagaacgggagggctgtacagctgcgacatcaccgcccgggggccatgcacgcggatcgagtttgataacgatgctgaccccacgtcagaaagcaaggaagatcagtggatgggggtcaccgtccagagccaaggtccagggggcaaggtcgtgacatgtgctcaccgatatgaaaaaaggcagcatgttaatacgaagcaggaatcccgagacatctttgggcggtgttatgtcctgagtcagaatctcaggattgaagacgatatggatgggggagattggagcttttgtgatgggcgattgagaggccatgagaaatttggctcttgccagcaaggtgtagcagctacttttactaaagactttcattacattgtatttggagccccgggtacttataactggaaagggattgttcgtgtagagcaaaagaataacactttttttgacatgaacatctttgaagatgggccttatgaagttggtggagagactgagcatgatgaaagtctcgttcctgttcctgctaacagttacttaggtttttctttggactcagggaaaggtattgtttctaaagatgagatcacttttgtatctggtgctcccagagccaatcacagtggagccgtggttttgctgaagagagacatgaagtctgcacatctcctccctgagcacatattcgatggagaaggtctggcctcttcatttggctatgatgtggcggtggtggacctcaacaaggatgggtggcaagatatagttattggagccccacagtattttgatagagatggagaagttggaggtgcagtgtatgtctacatgaaccagcaaggcagatggaataatgtgaagccaattcgtcttaatggaaccaaagattctatgtttggcattgcagtaaaaaatattggagatattaatcaagatggctacccagatattgcagttggagctccgtatgatgacttgggaaaggtttttatctatcatggatctgcaaatggaataaataccaaaccaacacaggttctcaagggtatatcaccttattttggatattcaattgctggaaacatggaccttgatcgaaattcctaccctgatgttgctgttggttccctctcagattcagtaactattttcagatcccggcctgtgattaatattcagaaaaccatcacagtaactcctaacagaattgacctccgccagaaaacagcgtgtggggcgcctagtgggatatgcctccaggttaaatcctgttttgaatatactgctaaccccgctggttataatccttcaatatcaattgtgggcacacttgaagctgaaaaagaaagaagaaaatctgggctatcctcaagagttcagtttcgaaaccaaggttctgagcccaaatatactcaagaactaactctgaagaggcagaaacagaaagtgtgcatggaggaaaccctgtggctacaggataatatcagagataaactgcgtcccattcccataactgcctcagtggagatccaagagccaagctctcgtaggcgagtgaattcacttccagaagttcttccaattctgaattcagatgaacccaagacagctcatattgatgttcacttcttaaaagagggatgtggagacgacaatgtatgtaacagcaaccttaaactagaatataaattttgcacccgagaaggaaatcaagacaaattttcttatttaccaattcaaaaaggtgtaccagaactagttctaaaagatcagaaggatattgctttagaaataacagtgacaaacagcccttccaacccaaggaatcccacaaaagatggcgatgacgcccatgaggctaaactgattgcaacgtttccagacactttaacctattctgcatatagagaactgagggctttccctgagaaacagttgagttgtgttgccaaccagaatggctcgcaagctgactgtgagctcggaaatccttttaaaagaaattcaaatgtcactttttatttggttttaagtacaactgaagtcacctttgacaccccagatctggatattaatctgaagttagaaacaacaagcaatcaagataatttggctccaattacagctaaagcaaaagtggttattgaactgcttttatcggtctcgggagttgctaaaccttcccaggtgtattttggaggtacagttgttggcgagcaagctatgaaatctgaagatgaagtgggaagtttaatagagtatgaattcagggtaataaacttaggtaaacctcttacaaacctcggcacagcaaccttgaacattcagtggccaaaagaaattagcaatgggaaatggttgctttatttggtgaaagtagaatccaaaggattggaaaaggtaacttgtgagccacaaaaggagataaactccctgaacctaacggagtctcacaactcaagaaagaaacgggaaattactgaaaaacagatagatgataacagaaaattttctttatttgctgaaagaaaataccagactcttaactgtagcgtgaacgtgaactgtgtgaacatcagatgcccgctgcgggggctggacagcaaggcgtctcttattttgcgctcgaggttatggaacagcacatttctagaggaatattccaaactgaactacttggacattctcatgcgagccttcattgatgtgactgctgctgccgaaaatatcaggctgccaaatgcaggcactcaggttcgagtgactgtgtttccctcaaagactgtagctcagtattcgggagtaccttggtggatcatcctagtggctattctcgctgggatcttgatgcttgctttattagtgtttatactatggaagtgtggattctttaaacgctctaggtacgatgacagtgttccccgataccatgctgtaaggatccggaaagaagagcgagagatcaaagatgaaaagtatattgataaccttgaaaaaaaacagtggatcacaaagtggaacgaaaatgaaagctactcatagcgggggcctaaaaaaaaaaagcttcacagtacccaaactgctttttccaactcagaaattcaatttggatttaaaagcctgctcaatccctgaggactgatttcagagtgactacacacagtacgaacctacagttttaactgtggatattgttacgtagcctaaggctcctgttttgcacagccaaatttaaaactgttggaatggatttttctttaactgccgtaatttaactttctgggttgcctttatttttggcgtggctgacttacatcatgtgttggggaagggcctgcccagttgcactcaggtgacatcctccagatagtgtagctgaggaggcacctacactcacctgcactaacagagtggccgtcctaacctcgggcctgctgcgcagacgtccatcacgttagctgtcccacatcacaagactatgccattggggtagttgtgtttcaacggaaagtgctgtcttaaactaaatgtgcaatagaaggtgatgttgccatcctaccgtcttttcctgtttcctagctgtgtgaatacctgctcacgtcaaatgcatacaagtttcattctccctttcactaaaacacacaggtgcaacagacttgaatgctagttatacttatttgtatatggtatttattttttcttttctttacaaaccattttgttattgactaacaggccaaagagtctccagtttacccttcaggttggtttaatcaatcagaattagagcatgggaggtcatcactttgacctaaattatttactgcaaaaagaaaatctttataaatgtaccagagagagttgttttaataacttatctataaactataacctctccttcatgacagcctccaccccacaacccaaaaggtttaagaaatagaattataactgtaaagatgtttatttcaggcattggatattttttactttagaagcctgcataatgtttctggatttcatactgtaacattcaggaattcttggagaaaatgggtttattcactgaactctagtgcggtttactcactgctgcaaatactgtatattcaggacttgaaagaaatggtgaatgcctatggtggatccaaactgatccagtataagactactgaatctgctaccaaaacagttaatcagtgagtcgatgttctattttttgttttgtttcctcccctatctgtattcccaaaaattactttggggctaatttaacaagaactttaaattgtgttttaattgtaaaaatggcagggggtggaattattactctatacattcaacagagactgaatagatatgaaagctgattttttttaattaccatgcttcacaatgttaagttatatggggagcaacagcaaacaggtgctaatttgttttggatatagtataagcagtgtctgtgttttgaaagaatagaacacagtttgtagtgccactgttgttttgggggggcttttttcttttcggaaatcttaaaccttaagatactaaggacgttgttttggttgtactttggaattcttagtcacaaaatatattttgtttacaaaaatttctgtaaaacaggttataacagtgtttaaagtctcagtttcttgcttggggaacttgtgtccctaatgtgtttagattgctagattgctaaggagctgatactttgacagtgtttttagacctgtgttactaaaaaaaagatgaatgtcctgaaaagggtgttgggagggtggttcaacaaagaaacaaagatgttatggtgtttagatttatggttgttaaaaatgtcatctcaagtcaagtcactggtctgtttgcatttgatacatttttgtactaactagcattgtaaaattatttcatgattagaaattacctgtggatatttgtataaaagtgtgaaataaattttttataaaagtgttcattgtttcgtaacacagcattgtatatgtgaagcaaactctaaaattataaatgacaacctgaattatctatttcatcaaacc

SEQ ID NO: 77 - DNA, 5463 bp, Homo sapiens
gcggccgctgcaggtccccgctcccctccccgtgcgtccgcccatggccgccgccgggcagctgtgcttgctctacctgtcggcggggctcctgtcccggctcggcgcagccttcaacttggacactcgggaggacaacgtgatccggaaatatggagaccccgggagcctcttcggcttctcgctggccatgcactggcaactgcagcccgaggacaagcggctgttgctcgtgggggccccgcgggcagaagcgcttccactgcagagagccaacagaacgggagggctgtacagctgcgacatcaccgcccgggggccatgcacgcggatcgagtttgataacgatgctgaccccacgtcagaaagcaaggaagatcagtggatgggggtcaccgtccagagccaaggtccagggggcaaggtcgtgacatgtgctcaccgatatgaaaaaaggcagcatgttaatacgaagcaggaatcccgagacatctttgggcggtgttatgtcctgagtcagaatctcaggattgaagacgatatggatgggggagattggagcttttgtgatgggcgattgagaggccatgagaaatttggctcttgccagcaaggtgtagcagctacttttactaaagactttcattacattgtatttggagccccgggtacttataactggaaagggattgttcgtgtagagcaaaagaataacactttttttgacatgaacatctttgaagatgggccttatgaagttggtggagagactgagcatgatgaaagtctcgttcctgttcctgctaacagttacttaggcctgctgtttttgaccagcgtttcctatacagatcctgatcagtttgtttataaaacacggcctccccgggagcagcctgacacattccctgatgtgatgatgaatagctacctaggtttttctttggactcagggaaaggtattgtttctaaagatgagatcacttttgtatctggtgctcccagagccaatcacagtggagccgtggttttgctgaagagagacatgaagtctgcacatctcctccctgagcacatattcgatggagaaggtctggcctcttcatttggctatgatgtggcggtggtggacctcaacaaggatgggtggcaagatatagttattggagccccacagtattttgatagagatggagaagttggaggtgcagtgtatgtctacatgaaccagcaaggcagatggaataatgtgaagccaattcgtcttaatggaaccaaagattctatgtttggcattgcagtaaaaaatattggagatattaatcaagatggctacccagatattgcagttggagctccgtatgatgacttgggaaaggtttttatctatcatggatctgcaaatggaataaataccaaaccaacacaggttctcaagggtatatcaccttattttggatattcaattgctggaaacatggaccttgatcgaaattcctaccctgatgttgctgttggttccctctcagattcagtaactattttcagatcccggcctgtgattaatattcagaaaaccatcacagtaactcctaacagaattgacctccgccagaaaacagcgtgtggggcgcctagtgggatatgcctccaggttaaatcctgttttgaatatactgctaaccccgctggttataatccttcaatatcaattgtgggcacacttgaagctgaaaaagaaagaagaaaatctgggctatcctcaagagttcagtttcgaaaccaaggttctgagcccaaatatactcaagaactaactctgaagaggcagaaacagaaagtgtgcatggaggaaaccctgtggctacaggataatatcagagataaactgcgtcccattcccataactgcctcagtggagatccaagagccaagctctcgtaggcgagtgaattcacttccagaagttcttccaattctgaattcagatgaacccaagacagctcatattgatgttcacttcttaaaagagggatgtggagacgacaatgtatgtaacagcaaccttaaactagaatataaattttgcacccgagaaggaaatcaagacaaattttcttatttaccaattcaaaaaggtgtaccagaactagttctaaaagatcagaaggatattgctttagaaataacagtgacaaacagcccttccaacccaaggaatcccacaaaagatggcgatgacgcccatgaggctaaactgattgcaacgtttccagacactttaacctattctgcatatagagaactgagggctttccctgagaaacagttgagttgtgttgccaaccagaatggctcgcaagctgactgtgagctcggaaatccttttaaaagaaattcaaatgtcactttttatttggttttaagtacaactgaagtcacctttgacaccccagatctggatattaatctgaagttagaaacaacaagcaatcaagataatttggctccaattacagctaaagcaaaagtggttattgaactgcttttatcggtctcgggagttgctaaaccttcccaggtgtattttggaggtacagttgttggcgagcaagctatgaaatctgaagatgaagtgggaagtttaatagagtatgaattcagggtaataaacttaggtaaacctcttacaaacctcggcacagcaaccttgaacattcagtggccaaaagaaattagcaatgggaaatggttgctttatttggtgaaagtagaatccaaaggattggaaaaggtaacttgtgagccacaaaaggagataaactccctgaacctaacggagtctcacaactcaagaaagaaacgggaaattactgaaaaacagatagatgataacagaaaattttctttatttgctgaaagaaaataccagactcttaactgtagcgtgaacgtgaactgtgtgaacatcagatgcccgctgcgggggctggacagcaaggcgtctcttattttgcgctcgaggttatggaacagcacatttctagaggaatattccaaactgaactacttggacattctcatgcgagccttcattgatgtgactgctgctgccgaaaatatcaggctgccaaatgcaggcactcaggttcgagtgactgtgtttccctcaaagactgtagctcagtattcgggagtaccttggtggatcatcctagtggctattctcgctgggatcttgatgcttgctttattagtgtttatactatggaagtgtggattctttaaacgctctaggtacgatgacagtgttccccgataccatgctgtaaggatccggaaagaagagcgagagatcaaagatgaaaagtatattgataaccttgaaaaaaaacagtggatcacaaagtggaacgaaaatgaaagctactcatagcgggggcctaaaaaaaaaaagcttcacagtacccaaactgctttttccaactcagaaattcaatttggatttaaaagcctgctcaatccctgaggactgatttcagagtgactacacacagtacgaacctacagttttaactgtggatattgttacgtagcctaaggctcctgttttgcacagccaaatttaaaactgttggaatggatttttctttaactgccgtaatttaactttctgggttgcctttatttttggcgtggctgacttacatcatgtgttggggaagggcctgcccagttgcactcaggtgacatcctccagatagtgtagctgaggaggcacctacactcacctgcactaacagagtggccgtcctaacctcgggcctgctgcgcagacgtccatcacgttagctgtcccacatcacaagactatgccattggggtagttgtgtttcaacggaaagtgctgtcttaaactaaatgtgcaatagaaggtgatgttgccatcctaccgtcttttcctgtttcctagctgtgtgaatacctgctcacgtcaaatgcatacaagtttcattctccctttcactaaaacacacaggtgcaacagacttgaatgctagttatacttatttgtatatggtatttattttttcttttctttacaaaccattttgttattgactaacaggccaaagagtctccagtttacccttcaggttggtttaatcaatcagaattagagcatgggaggtcatcactttgacctaaattatttactgcaaaaagaaaatctttataaatgtaccagagagagttgttttaataacttatctataaactataacctctccttcatgacagcctccaccccacaacccaaaaggtttaagaaatagaattataactgtaaagatgtttatttcaggcattggatattttttactttagaagcctgcataatgtttctggatttcatactgtaacattcaggaattcttggagaaaatgggtttattcactgaactctagtgcggtttactcactgctgcaaatactgtatattcaggacttgaaagaaatggtgaatgcctatggtggatccaaactgatccagtataagactactgaatctgctaccaaaacagttaatcagtgagtcgatgttctattttttgttttgtttcctcccctatctgtattcccaaaaattactttggggctaatttaacaagaactttaaattgtgttttaattgtaaaaatggcagggggtggaattattactctatacattcaacagagactgaatagatatgaaagctgattttttttaattaccatgcttcacaatgttaagttatatggggagcaacagcaaacaggtgctaatttgttttggatatagtataagcagtgtctgtgttttgaaagaatagaacacagtttgtagtgccactgttgttttgggggggcttttttcttttcggaaatcttaaaccttaagatactaaggacgttgttttggttgtactttggaattcttagtcacaaaatatattttgtttacaaaaatttctgtaaaacaggttataacagtgtttaaagtctcagtttcttgcttggggaacttgtgtccctaatgtgtttagattgctagattgctaaggagctgatactttgacagtgtttttagacctgtgttactaaaaaaaagatgaatgtcctgaaaagggtgttgggagggtggttcaacaaagaaacaaagatgttatggtgtttagatttatggttgttaaaaatgtcatctcaagtcaagtcactggtctgtttgcatttgatacatttttgtactaactagcattgtaaaattatttcatgattagaaattacctgtggatatttgtataaaagtgtgaaataaattttttataaaagtgttcattgtttcgtaacacagcattgtatatgtgaagcaaactctaaaattataaatgacaacctgaattatctatttcatcaaacc

SEQ ID NO: 78 - DNA, 5476 bp, Homo sapiens; identical to SEQ ID NO: 75

SEQ ID NO: 79 - DNA, 5463 bp, Homo sapiens; identical to SEQ ID NO: 77

SEQ ID NO: 80 - DNA, 5476 bp, Homo sapiens; identical to SEQ ID NO: 75

SEQ ID NO: 81 - protein, 529 aa, Homo sapiens
MSQDTEVDMKEVELNELEPEKQPMNAASGAAMSLAGAEKNGLVKIKVAEDEAEAAAAAKFTGLSKEELLKVAGSPGWVRTRWALLLLFWLGWLGMLAGAVVIIVRAPRCRELPAQKWWHTGALYRIGDLQAFQGHGAGNLAGLKGRLDYLSSLKVKGLVLGPIHKNQKDDVAQTDLLQIDPNFGSKEDFDSLLQSAKKKSIRVILDLTPNYRGENSWFSTQVDTVATKVKDALEFWLQAGVDGFQVRDIENLKDASSFLAEWQNITKGFSEDRLLIAGTNSSDLQQILSLLESNKDLLLTSSYLSDSGSTGEHTKSLVTQYLNATGNRWCSWSLSQARLLTSFLPAQLLRLYQLMLFTLPGTPVFSYGDEIGLDAAALPGQPMEAPVMLWDESSFPDIPGAVSANMTVKGQSEDPGSLLSLFRRLSDQRSKERSLLHGDFHAFSAGPGLFSYIRHWDQNERFLVVLNFGDVGLSAGLQASDLPASASLPAKADLLLSTQPGREEGSPLELERLKLEPHEGLLLRFPYAA

SEQ ID NO: 82 - protein, 398 aa, Homo sapiens
MSQDTEVDMKEVELNELEPEKQPMNAASGAAMSLAGAEKNGLVKIKVAEDEAEAAAAAKFTGLSKEELLKVAGSPGWVRTRWALLLLFWLGWLGMLAGAVVIIVRAPRCRELPAQKWWHTGALYRIGDLQAFQGHGAGNLAGLKGRLDYLSSLKVKGLVLGPIHKNQKDDVAQTDLLQIDPNFGSKEDFDSLLQSAKKKSIRVILDLTPNYRGENSWFSTQVDTVATKVKDALEFWLQAGVDGFQVRDIENLKDASSFLAEWQNITKGFSEDRLLIAGTNSSDLQQILSLLESNKDLLLTSSYLSDSGSTGEHTKSLVTQYLNATGNRWCSWSLSQARLLTSFLPAQLLRLYQLMLFTLPGTPVFSYGDEIGLDAAALPGQVLLAVFLSQGGCLSILQ

SEQ ID NO: 83 - protein, 630 aa, Homo sapiens
MELQPPEASIAVVSIPRQLPGSHSEAGVQGLSAGDDSELGSHCVAQTGLELLASGDPLPSASQNAEMIETGSDCVTQAGLQLLASSDPPALASKNAEVTGTMSQDTEVDMKEVELNELEPEKQPMNAASGAAMSLAGAEKNGLVKIKVAEDEAEAAAAAKFTGLSKEELLKVAGSPGWVRTRWALLLLFWLGWLGMLAGAVVIIVRAPRCRELPAQKWWHTGALYRIGDLQAFQGHGAGNLAGLKGRLDYLSSLKVKGLVLGPIHKNQKDDVAQTDLLQIDPNFGSKEDFDSLLQSAKKKSIRVILDLTPNYRGENSWFSTQVDTVATKVKDALEFWLQAGVDGFQVRDIENLKDASSFLAEWQNITKGFSEDRLLIAGTNSSDLQQILSLLESNKDLLLTSSYLSDSGSTGEHTKSLVTQYLNATGNRWCSWSLSQARLLTSFLPAQLLRLYQLMLFTLPGTPVFSYGDEIGLDAAALPGQPMEAPVMLWDESSFPDIPGAVSANMTVKGQSEDPGSLLSLFRRLSDQRSKERSLLHGDFHAFSAGPGLFSYIRHWDQNERFLVVLNFGDVGLSAGLQASDLPASASLPAKADLLLSTQPGREEGSPLELERLKLEPHEGLLLRFPYAA

SEQ ID NO: 84 - protein, 631 aa, Homo sapiens
MELQPPEASIAVVSIPRQLPGSHSEAGVQGLSAGDDSETGSDCVTQAGLQLLASSDPPALASKNAEVTVETGFHHVSQADIEFLTSIDPTASASGSAGITGTMSQDTEVDMKEVELNELEPEKQPMNAASGAAMSLAGAEKNGLVKIKVAEDEAEAAAAAKFTGLSKEELLKVAGSPGWVRTRWALLLLFWLGWLGMLAGAVVIIVRAPRCRELPAQKWWHTGALYRIGDLQAFQGHGAGNLAGLKGRLDYLSSLKVKGLVLGPIHKNQKDDVAQTDLLQIDPNFGSKEDFDSLLQSAKKKSIRVILDLTPNYRGENSWFSTQVDTVATKVKDALEFWLQAGVDGFQVRDIENLKDASSFLAEWQNITKGFSEDRLLIAGTNSSDLQQILSLLESNKDLLLTSSYLSDSGSTGEHTKSLVTQYLNATGNRWCSWSLSQARLLTSFLPAQLLRLYQLMLFTLPGTPVFSYGDEIGLDAAALPGQPMEAPVMLWDESSFPDIPGAVSANMTVKGQSEDPGSLLSLFRRLSDQRSKERSLLHGDFHAFSAGPGLFSYIRHWDQNERFLVVLNFGDVGLSAGLQASDLPASASLPAKADLLLSTQPGREEGSPLELERLKLEPHEGLLLRFPYAA

SEQ ID NO: 85 - protein, 568 aa, Homo sapiens
MELQPPEASIAVVSIPRQLPGSHSEAGVQGLSAGDDSGTMSQDTEVDMKEVELNELEPEKQPMNAASGAAMSLAGAEKNGLVKIKVAEDEAEAAAAAKFTGLSKEELLKVAGSPGWVRTRWALLLLFWLGWLGMLAGAVVIIVRAPRCRELPAQKWWHTGALYRIGDLQAFQGHGAGNLAGLKGRLDYLSSLKVKGLVLGPIHKNQKDDVAQTDLLQIDPNFGSKEDFDSLLQSAKKKSIRVILDLTPNYRGENSWFSTQVDTVATKVKDALEFWLQAGVDGFQVRDIENLKDASSFLAEWQNITKGFSEDRLLIAGTNSSDLQQILSLLESNKDLLLTSSYLSDSGSTGEHTKSLVTQYLNATGNRWCSWSLSQARLLTSFLPAQLLRLYQLMLFTLPGTPVFSYGDEIGLDAAALPGQPMEAPVMLWDESSFPDIPGAVSANMTVKGQSEDPGSLLSLFRRLSDQRSKERSLLHGDFHAFSAGPGLFSYIRHWDQNERFLVVLNFGDVGLSAGLQASDLPASASLPAKADLLLSTQPGREEGSPLELERLKLEPHEGLLLRFPYAA

SEQ ID NO: 86 - DNA, 2313 bp, Homo sapiens
aaaccagacggcggccggagccgtgaaccaggggcaaatggaggatggtgttggggtagtcactagcctgccggaatggaagaagaggggcgtttgggggcggtaaggcctaaaggacactggaggggcctcgggatttggggcaggatcacaggcctagtccacttaaaggtggctccgtgccaggccttcccagaatcaggttgaaaagaactttagggttagacaggttggagatgagaaattggaccatgcaggaagtactgtcggaggcgtgttcctgactttactaccctgagccgcccacggctggggcagtccccgaggttccaccttaaggggcgggccggggcggggctccgctgccccttcccagaggccgcgcctgctgctgagcagatgcagtagccgaaactgcgcggaggcacagaggccggggagagcgttctgggtccgagggtccaggtaggggttgagccaccatctgaccgcaagctgcgtcgtgtcgccggttctgcaggcaccatgagccaggacaccgaggtggatatgaaggaggtggagctgaatgagttagagcccgagaagcagccgatgaacgcggcgtctggggcggccatgtccctggcgggagccgagaagaatggtctggtgaagatcaaggtggcggaagacgaggcggaggcggcagccgcggctaagttcacgggcctgtccaaggaggagctgctgaaggtggcaggcagccccggctgggtacgcacccgctgggcactgctgctgctcttctggctcggctggctcggcatgcttgctggtgccgtggtcataatcgtgcgagcgccgcgttgtcgcgagctaccggcgcagaagtggtggcacacgggcgccctctaccgcatcggcgaccttcaggccttccagggccacggcgcgggcaacctggcgggtctgaaggggcgtctcgattacctgagctctctgaaggtgaagggccttgtgctgggtccaattcacaagaaccagaaggatgatgtcgctcagactgacttgctgcagatcgaccccaattttggctccaaggaagattttgacagtctcttgcaatcggctaaaaaaaagagcatccgtgtcattctggaccttactcccaactaccggggtgagaactcgtggttctccactcaggttgacactgtggccaccaaggtgaaggatgctctggagttttggctgcaagctggcgtggatgggttccaggttcgggacatagagaatctgaaggatgcatcctcattcttggctgagtggcaaaatatcaccaagggcttcagtgaagacaggctcttgattgcggggactaactcctccgaccttcagcagatcctgagcctactcgaatccaacaaagacttgctgttgactagctcatacctgtctgattctggttctactggggagcatacaaaatccctagtcacacagtatttgaatgccactggcaatcgctggtgcagctggagtttgtctcaggcaaggctcctgacttccttcttgccggctcaacttctccgactctaccagctgatgctcttcaccctgccagggacccctgttttcagctacggggatgagattggcctggatgcagctgcccttcctggacagcctatggaggctccagtcatgctgtgggatgagtccagcttccctgacatcccaggggctgtaagtgccaacatgactgtgaagggccagagtgaagaccctggctccctcctttccttgttccggcggctgagtgaccagcggagtaaggagcgctccctactgcatggggacttccacgcgttctccgctgggcctggactcttctcctatatccgccactgggaccagaatgagcgttttctggtagtgcttaactttggggatgtgggcctctcggctggactgcaggcctccgacctgcctgccagcgccagcctgccagccaaggctgacctcctgctcagcacccagccaggccgtgaggagggctcccctcttgagctggaacgcctgaaactggagcctcacgaagggctgctgctccgcttcccctacgcggcctgacttcagcctgacatggacccactacccttctcctttccttcccaggccctttggcttctgatttttctcttttttaaaaacaaacaaacaaactgttgcagattatgagtgaacccccaaatagggtgttttctgccttcaaataaaagtcacccctgcatggtgaagtcttccctctgcttctctcatagcaggaat

SEQ ID NO: 87 - DNA, 1722 bp, Homo sapiens
aaaccagacggcggccggagccgtgaaccaggggcaaatggaggatggtgttggggtagtcactagcctgccggaatggaagaagaggggcgtttgggggcggtaaggcctaaaggacactggaggggcctcgggatttggggcaggatcacaggcctagtccacttaaaggtggctccgtgccaggccttcccagaatcaggttgaaaagaactttagggttagacaggttggagatgagaaattggaccatgcaggaagtactgtcggaggcgtgttcctgactttactaccctgagccgcccacggctggggcagtccccgaggttccaccttaaggggcgggccggggcggggctccgctgccccttcccagaggccgcgcctgctgctgagcagatgcagtagccgaaactgcgcggaggcacagaggccggggagagcgttctgggtccgagggtccaggtaggggttgagccaccatctgaccgcaagctgcgtcgtgtcgccggttctgcaggcaccatgagccaggacaccgaggtggatatgaaggaggtggagctgaatgagttagagcccgagaagcagccgatgaacgcggcgtctggggcggccatgtccctggcgggagccgagaagaatggtctggtgaagatcaaggtggcggaagacgaggcggaggcggcagccgcggctaagttcacgggcctgtccaaggaggagctgctgaaggtggcaggcagccccggctgggtacgcacccgctgggcactgctgctgctcttctggctcggctggctcggcatgcttgctggtgccgtggtcataatcgtgcgagcgccgcgttgtcgcgagctaccggcgcagaagtggtggcacacgggcgccctctaccgcatcggcgaccttcaggccttccagggccacggcgcgggcaacctggcgggtctgaaggggcgtctcgattacctgagctctctgaaggtgaagggccttgtgctgggtccaattcacaagaaccagaaggatgatgtcgctcagactgacttgctgcagatcgaccccaattttggctccaaggaagattttgacagtctcttgcaatcggctaaaaaaaagagcatccgtgtcattctggaccttactcccaactaccggggtgagaactcgtggttctccactcaggttgacactgtggccaccaaggtgaaggatgctctggagttttggctgcaagctggcgtggatgggttccaggttcgggacatagagaatctgaaggatgcatcctcattcttggctgagtggcaaaatatcaccaagggcttcagtgaagacaggctcttgattgcggggactaactcctccgaccttcagcagatcctgagcctactcgaatccaacaaagacttgctgttgactagctcatacctgtctgattctggttctactggggagcatacaaaatccctagtcacacagtatttgaatgccactggcaatcgctggtgcagctggagtttgtctcaggcaaggctcctgacttccttcttgccggctcaacttctccgactctaccagctgatgctcttcaccctgccagggacccctgttttcagctacggggatgagattggcctggatgcagctgcccttcctggacaggtactgcttgctgtctttctgtcacagggaggttgtttatccatcttacaatga

SEQ ID NO: 88 - DNA, 2230 bp, Homo sapiens
cccagtgcatgtggcaggagcggtgagatcactgcctcacggcgatcctggactgacggtcacgactgcctaccctctaaccctgttctgagctgccccttgcccacacaccccaaacctgtgtgcaggatccgcctccatggagctacagcctcctgaagcctcgatcgccgtcgtgtcgattccgcgccagttgcctggctcacattcggaggctggtgtccagggtctcagcgcgggggacgactcagagttggggtctcactgtgttgcccagactggtctcgaactcttggcctcaggtgatcctcttccctcagcttcccagaatgccgagatgatagagacggggtctgactgtgttacccaggctggtcttcaactcttggcctcaagtgatcctcctgccttagcttccaagaatgctgaggttacaggcaccatgagccaggacaccgaggtggatatgaaggaggtggagctgaatgagttagagcccgagaagcagccgatgaacgcggcgtctggggcggccatgtccctggcgggagccgagaagaatggtctggtgaagatcaaggtggcggaagacgaggcggaggcggcagccgcggctaagttcacgggcctgtccaaggaggagctgctgaaggtggcaggcagccccggctgggtacgcacccgctgggcactgctgctgctcttctggctcggctggctcggcatgcttgctggtgccgtggtcataatcgtgcgagcgccgcgttgtcgcgagctaccggcgcagaagtggtggcacacgggcgccctctaccgcatcggcgaccttcaggccttccagggccacggcgcgggcaacctggcgggtctgaaggggcgtctcgattacctgagctctctgaaggtgaagggccttgtgctgggtccaattcacaagaaccagaaggatgatgtcgctcagactgacttgctgcagatcgaccccaattttggctccaaggaagattttgacagtctcttgcaatcggctaaaaaaaagagcatccgtgtcattctggaccttactcccaactaccggggtgagaactcgtggttctccactcaggttgacactgtggccaccaaggtgaaggatgctctggagttttggctgcaagctggcgtggatgggttccaggttcgggacatagagaatctgaaggatgcatcctcattcttggctgagtggcaaaatatcaccaagggcttcagtgaagacaggctcttgattgcggggactaactcctccgaccttcagcagatcctgagcctactcgaatccaacaaagacttgctgttgactagctcatacctgtctgattctggttctactggggagcatacaaaatccctagtcacacagtatttgaatgccactggcaatcgctggtgcagctggagtttgtctcaggcaaggctcctgacttccttcttgccggctcaacttctccgactctaccagctgatgctcttcaccctgccagggacccctgttttcagctacggggatgagattggcctggatgcagctgcccttcctggacagcctatggaggctccagtcatgctgtgggatgagtccagcttccctgacatcccaggggctgtaagtgccaacatgactgtgaagggccagagtgaagaccctggctccctcctttccttgttccggcggctgagtgaccagcggagtaaggagcgctccctactgcatggggacttccacgcgttctccgctgggcctggactcttctcctatatccgccactgggaccagaatgagcgttttctggtagtgcttaactttggggatgtgggcctctcggctggactgcaggcctccgacctgcctgccagcgccagcctgccagccaaggctgacctcctgctcagcacccagccaggccgtgaggagggctcccctcttgagctggaacgcctgaaactggagcctcacgaagggctgctgctccgcttcccctacgcggcctgacttcagcctgacatggacccactacccttctcctttccttcccaggccctttggcttctgatttttctcttttttaaaaacaaacaaacaaactgttgcagattatgagtgaacccccaaatagggtgttttctgccttcaaataaaagtcacccctgcatggtgaagtcttccctctgcttctctcatagcaggaat

SEQ ID NO: 89 - DNA, 2230 bp, Homo sapiens; identical to SEQ ID NO: 88

SEQ ID NO: 90 - DNA, 2230 bp, Homo sapiens; identical to SEQ ID NO: 88

SEQ ID NO: 91 - protein, 1752 aa, Homo sapiens
MAGPRPSPWARLLLAALISVSLSGTLANRCKKAPVKSCTECVRVDKDCAYCTDEMFRDRRCNTQAELLAAGCQRESIVVMESSFQITEETQIDTTLRRSQMSPQGLRVRLRPGEERHFELEVFEPLESPVDLYILMDFSNSMSDDLDNLKKMGQNLARVLSQLTSDYTIGFGKFVDKVSVPQTDMRPEKLKEPWPNSDPPFSFKNVISLTEDVDEFRNKLQGERISGNLDAPEGGFDAILQTAVCTRDIGWRPDSTHLLVFSTESAFHYEADGANVLAGIMSRNDERCHLDTTGTYTQYRTQDYPSVPTLVRLLAKHNIIPIFAVTNYSYSYYEKLHTYFPVSSLGVLQEDSSNIVELLEEAFNRIRSNLDIRALDSPRGLRTEVTSKMFQKTRTGSFHIRRGEVGIYQVQLRALEHVDGTHVCQLPEDQKGNIHLKPSFSDGLKMDAGIICDVCTCELQKEVRSARCSFNGDFVCGQCVCSEGWSGQTCNCSTGSLSDIQPCLREGEDKPCSGRGECQCGHCVCYGEGRYEGQFCEYDNFQCPRTSGFLCNDRGRCSMGQCVCEPGWTGPSCDCPLSNATCIDSNGGICNGRGHCECGRCHCHQQSLYTDTICEINYSAIHPGLCEDLRSCVQCQAWGTGEKKGRTCEECNFKVKMVDELKRAEEVVVRCSFRDEDDDCTYSYTMEGDGAPGPNSTVLVHKKKDCPPGSFWWLIPLLLLLLPLLALLLLLCWKYCACCKACLALLPCCNRGHMVGFKEDHYMLRENLMASDHLDTPMLRSGNLKGRDVVRWKVTNNMQRPGFATHAASINPTELVPYGLSLRLARLCTENLLKPDTRECAQLRQEVEENLNEVYRQISGVHKLQQTKFRQQPNAGKKQDHTIVDTVLMAPRSAKPALLKLTEKQVEQRAFHDLKVAPGYYTLTADQDARGMVEFQEGVELVDVRVPLFIRPEDDDEKQLLVEAIDVPAGTATLGRRLVNITIIKEQARDVVSFEQPEFSVSRGDQVARIPVIRRVLDGGKSQVSYRTQDGTAQGNRDYIPVEGELLFQPGEAWKELQVKLLELQEVDSLLRGRQVRRFHVQLSNPKFGAHLGQPHSTTIIIRDPDELDRSFTSQMLSSQPPPHGDLGAPQNPNAKAAGSRKIHFNWLPPSGKPMGYRVKYWIQGDSESEAHLLDSKVPSVELTNLYPYCDYEMKVCAYGAQGEGPYSSLVSCRTHQEVPSEPGRLAFNVVSSTVTQLSWAEPAETNGEITAYEVCYGLVNDDNRPIGPMKKVLVDNPKNRMLLIENLRESQPYRYTVKARNGAGWGPEREAIINLATQPKRPMSIPIIPDIPIVDAQSGEDYDSFLMYSDDVLRSPSGSQRPSVSDDTEHLVNGRMDFAFPGSTNSLHRMTTTSAAAYGTHLSPHVPHRVLSTSSTLTRDYNSLTRSEHSHSTTLPRDYSTLTSVSSHDSRLTAGVPDTPTRLVFSALGPTSLRVSWQEPRCERPLQGYSVEYQLLNGGELHRLNIPNPAQTSVVVEDLLPNHSYVFRVRAQSQEGWGREREGVITIESQVHPQSPLCPLPGSAFTLSTPSAPGPLVFTALSPDSLQLSWERPRRPNGDIVGYLVTCEMAQGGGPATAFRVDGDSPESRLTVPGLSENVPYKFKVQARTTEGFGPEREGIITIESQDGGPFPQLGSRAGLFQHPLQSEYSSITTTHTSATEPFLVDGLTLGAQHLEAGGSLTRHVTQEFVSRTLTTSGTLSTHMDQQFFQT

SEQ ID NO: 92 - protein, 734 aa, Homo sapiens
MAGPRPSPWARLLLAALISVSLSGTLANRCKKAPVKSCTECVRVDKDCAYCTDEMFRDRRCNTQAELLAAGCQRESIVVMESSFQITEETQIDTTLRRSQMSPQGLRVRLRPGEERHFELEVFEPLESPVDLYILMDFSNSMSDDLDNLKKMGQNLARVLSQLTSDYTIGFGKFVDKVSVPQTDMRPEKLKEPWPNSDPPFSFKNVISLTEDVDEFRNKLQGERISGNLDAPEGGFDAILQTAVCTRDIGWRPDSTHLLVFSTESAFHYEADGANVLAGIMSRNDERCHLDTTGTYTQYRTQDYPSVPTLVRLLAKHNIIPIFAVTNYSYSYYEKLHTYFPVSSLGVLQEDSSNIVELLEEAFNRIRSNLDIRALDSPRGLRTEVTSKMFQKTRTGSFHIRRGEVGIYQVQLRALEHVDGTHVCQLPEDQKGNIHLKPSFSDGLKMDAGIICDVCTCELQKEVRSARCSFNGDFVCGQCVCSEGWSGQTCNCSTGSLSDIQPCLREGEDKPCSGRGECQCGHCVCYGEGRYEGQFCEYDNFQCPRTSGFLCNDRGRCSMGQCVCEPGWTGPSCDCPLSNATCIDSNGIHPGLCEDLRSCVQCQAWGTGEKKGRTCEECNFKVKMVDELKRAEEVVVRCSFRDEDDDCTYSYTMEGDGAPGPNSTVLVHKKKGTTSPCLLLSRLPSGLLLVAHPPAPPPPAAPGPATAAMLEVLCLLQGLPGTSPVLQPRSHGGL

SEQ ID NO: 93 - protein, 1822 aa, Homo sapiens
MAGPRPSPWARLLLAALISVSLSGTLANRCKKAPVKSCTECVRVDKDCAYCTDEMFRDRRCNTQAELLAAGCQRESIVVMESSFQITEETQIDTTLRRSQMSPQGLRVRLRPGEERHFELEVFEPLESPVDLYILMDFSNSMSDDLDNLKKMGQNLARVLSQLTSDYTIGFGKFVDKVSVPQTDMRPEKLKEPWPNSDPPFSFKNVISLTEDVDEFRNKLQGERISGNLDAPEGGFDAILQTAVCTRDIGWRPDSTHLLVFSTESAFHYEADGANVLAGIMSRNDERCHLDTTGTYTQYRTQDYPSVPTLVRLLAKHNIIPIFAVTNYSYSYYEKLHTYFPVSSLGVLQEDSSNIVELLEEAFNRIRSNLDIRALDSPRGLRTEVTSKMFQKTRTGSFHIRRGEVGIYQVQLRALEHVDGTHVCQLPEDQKGNIHLKPSFSDGLKMDAGIICDVCTCELQKEVRSARCSFNGDFVCGQCVCSEGWSGQTCNCSTGSLSDIQPCLREGEDKPCSGRGECQCGHCVCYGEGRYEGQFCEYDNFQCPRTSGFLCNDRGRCSMGQCVCEPGWTGPSCDCPLSNATCIDSNGGICNGRGHCECGRCHCHQQSLYTDTICEINYSAIHPGLCEDLRSCVQCQAWGTGEKKGRTCEECNFKVKMVDELKRAEEVVVRCSFRDEDDDCTYSYTMEGDGAPGPNSTVLVHKKKDCPPGSFWWLIPLLLLLLPLLALLLLLCWKYCACCKACLALLPCCNRGHMVGFKEDHYMLRENLMASDHLDTPMLRSGNLKGRDVVRWKVTNNMQRPGFATHAASINPTELVPYGLSLRLARLCTENLLKPDTRECAQLRQEVEENLNEVYRQISGVHKLQQTKFRQQPNAGKKQDHTIVDTVLMAPRSAKPALLKLTEKQVEQRAFHDLKVAPGYYTLTADQDARGMVEFQEGVELVDVRVPLFIRPEDDDEKQLLVEAIDVPAGTATLGRRLVNITIIKEQARDVVSFEQPEFSVSRGDQVARIPVIRRVLDGGKSQVSYRTQDGTAQGNRDYIPVEGELLFQPGEAWKELQVKLLELQEVDSLLRGRQVRRFHVQLSNPKFGAHLGQPHSTTIIIRDPDELDRSFTSQMLSSQPPPHGDLGAPQNPNAKAAGSRKIHFNWLPPSGKPMGYRVKYWIQGDSESEAHLLDSKVPSVELTNLYPYCDYEMKVCAYGAQGEGPYSSLVSCRTHQEVPSEPGRLAFNVVSSTVTQLSWAEPAETNGEITAYEVCYGLVNDDNRPIGPMKKVLVDNPKNRMLLIENLRESQPYRYTVKARNGAGWGPEREAIINLATQPKRPMSIPIIPDIPIVDAQSGEDYDSFLMYSDDVLRSPSGSQRPSVSDDTGCGWKFEPLLGEELDLRRVTWRLPPELIPRLSASSGRSSDAEAPHGPPDDGGAGGKGGSLPRSATPGPPGEHLVNGRMDFAFPGSTNSLHRMTTTSAAAYGTHLSPHVPHRVLSTSSTLTRDYNSLTRSEHSHSTTLPRDYSTLTSVSSHDSRLTAGVPDTPTRLVFSALGPTSLRVSWQEPRCERPLQGYSVEYQLLNGGELHRLNIPNPAQTSVVVEDLLPNHSYVFRVRAQSQEGWGREREGVITIESQVHPQSPLCPLPGSAFTLSTPSAPGPLVFTALSPDSLQLSWERPRRPNGDIVGYLVTCEMAQGGGPATAFRVDGDSPESRLTVPGLSENVPYKFKVQARTTEGFGPEREGIITIESQDGGPFPQLGSRAGLFQHPLQSEYSSITTTHTSATEPFLVDGLTLGAQHLEAGGSLTRHVTQEFVSRTLTTSGTLSTHMDQQFFQT

SEQ ID NO: 94 - protein, 1315 aa, Homo sapiens
MTTSSVPALPGSSAMTEDAAPWASVCVSLVGQAQAVTVPSAMPPASTAMGSTRASARTYAPACSARRGAPARRRGARVRNATSRSRWWTSLREPRRWWCAAPSGTRMTTAPTATPWKVTAPLGPTALSWCTRRRAPPPPASSSPDCPPGSFWWLIPLLLLLLPLLALLLLLCWKYCACCKACLALLPCCNRGHMVGFKEDHYMLRENLMASDHLDTPMLRSGNLKGRDVVRWKVTNNMQRPGFATHAASINPTELVPYGLSLRLARLCTENLLKPDTRECAQLRQEVEENLNEVYRQISGVHKLQQTKFRQQPNAGKKQDHTIVDTVLMAPRSAKPALLKLTEKQVEQRAFHDLKVAPGYYTLTADQDARGMVEFQEGVELVDVRVPLFIRPEDDDEKQLLVEAIDVPAGTATLGRRLVNITIIKEQARDVVSFEQPEFSVSRGDQVARIPVIRRVLDGGKSQVSYRTQDGTAQGNRDYIPVEGELLFQPGEAWKELQVKLLELQEVDSLLRGRQVRRFHVQLSNPKFGAHLGQPHSTTIIIRDPDELDRSFTSQMLSSQPPPHGDLGAPQNPNAKAAGSRKIHFNWLPPSGKPMGYRVKYWIQGDSESEAHLLDSKVPSVELTNLYPYCDYEMKVCAYGAQGEGPYSSLVSCRTHQEVPSEPGRLAFNVVSSTVTQLSWAEPAETNGEITAYEVCYGLVNDDNRPIGPMKKVLVDNPKNRMLLIENLRESQPYRYTVKARNGAGWGPEREAIINLATQPKRPMSIPIIPDIPIVDAQSGEDYDSFLMYSDDVLRSPSGSQRPSVSDDTGCGWKFEPLLGEELDLRRVTWRLPPELIPRLSASSGRSSDAEAPHGPPDDGGAGGKGGSLPRSATPGPPGEHLVNGRMDFAFPGSTNSLHRMTTTSAAAYGTHLSPHVPHRVLSTSSTLTRDYNSLTRSEHSHSTTLPRDYSTLTSVSSHGLPPIWEHGRSRLPLSWALGSRSRAQMKGFPPSRGPRDSIILAGRPAAPSWGPDSRLTAGVPDTPTRLVFSALGPTSLRVSWQEPRCERPLQGYSVEYQLLNGGELHRLNIPNPAQTSVVVEDLLPNHSYVFRVRAQSQEGWGREREGVITIESQVHPQSPLCPLPGSAFTLSTPSAPGPLVFTALSPDSLQLSWERPRRPNGDIVGYLVTCEMAQGGGPATAFRVDGDSPESRLTVPGLSENVPYKFKVQARTTEGFGPEREGIITIESQDGGPFPQLGSRAGLFQHPLQSEYSSITTTHTSATEPFLVDGLTLGAQHLEAGGSLTRHVTQEFVSRTLTTSGTLSTHMDQQFFQT

SEQ ID NO: 95 - protein, 1702 aa, Homo sapiens
MAGPRPSPWARLLLAALISVSLSGTLANRCKKAPVKSCTECVRVDKDCAYCTDEMFRDRRCNTQAELLAAGCQRESIVVMESSFQITEETQIDTTLRRSQMSPQGLRVRLRPGEERHFELEVFEPLESPVDLYILMDFSNSMSDDLDNLKKMGQNLARVLSQLTSDYTIGFGKFVDKVSVPQTDMRPEKLKEPWPNSDPPFSFKNVISLTEDVDEFRNKLQGERISGNLDAPEGGFDAILQTAVCTRDIGWRPDSTHLLVFSTESAFHYEADGANVLAGIMSRNDERCHLDTTGTYTQYRTQDYPSVPTLVRLLAKHNIIPIFAVTNYSYSYYEKLHTYFPVSSLGVLQEDSSNIVELLEEAFNRIRSNLDIRALDSPRGLRTEVTSKMFQKTRTGSFHIRRGEVGIYQVQLRALEHVDGTHVCQLPEDQKGNIHLKPSFSDGLKMDAGIICDVCTCELQKEVRSARCSFNGDFVCGQCVCSEGWSGQTCNCSTGSLSDIQPCLREGEDKPCSGRGECQCGHCVCYGEGRYEGQFCEYDNFQCPRTSGFLCNDRGRCSMGQCVCEPGWTGPSCDCPLSNATCIDSNGGICNGRGHCECGRCHCHQQSLYTDTICEINYSAIHPGLCEDLRSCVQCQAWGTGEKKGRTCEECNFKVKMVDELKRAEEVVVRCSFRDEDDDCTYSYTMEGDGAPGPNSTVLVHKKKDCPPGSFWWLIPLLLLLLPLLALLLLLCWKYCACCKACLALLPCCNRGHMVGFKEDHYMLRENLMASDHLDTPMLRSGNLKGRDVVRWKVTNNMQRPGFATHAASINPTELVPYGLSLRLARLCTENLLKPDTRECAQLRQEVEENLNEVYRQISGVHKLQQTKFRQQPNAGKKQDHTIVDTVLMAPRSAKPALLKLTEKQVEQRAFHDLKVAPGYYTLTADQDARGMVEFQEGVELVDVRVPLFIRPEDDDEKQLLVEAIDVPAGTATLGRRLVNITIIKEQARDVVSFEQPEFSVSRGDQVARIPVIRRVLDGGKSQVSYRTQDGTAQGNRDYIPVEGELLFQPGEAWKELQVKLLELQEVDSLLRGRQVRRFHVQLSNPKFGAHLGQPHSTTIIIRDPDELDRSFTSQMLSSQPPPHGDLGAPQNPNAKAAGSRKIHFNWLPPSGKPMGYRVKYWIQGDSESEAHLLDSKVPSVELTNLYPYCDYEMKVCAYGAQGEGPYSSLVSCRTHQEVPSEPGRLAFNVVSSTVTQLSWAEPAETNGEITAYEVCYGLVNDDNRPIGPMKKVLVDNPKNRMLLIENLRESQPYRYTVKARNGAGWGPEREAIINLATQPKRPMSIPIIPDIPIVDAQSGEDYDSFLMYSDDVLRSPSGSQRPSVSDDTEHLVNGRMDFAFPGSTNSLHRMTTTSAAAYGTHLSPHVPHRVLSTSSTLTRDYNSLTRSEHSHSTTLPRDYSTLTSVSSHGELHRLNIPNPAQTSVVVEDLLPNHSYVFRVRAQSQEGWGREREGVITIESQVHPQSPLCPLPGSAFTLSTPSAPGPLVFTALSPDSLQLSWERPRRPNGDIVGYLVTCEMAQGGGPATAFRVDGDSPESRLTVPGLSENVPYKFKVQARTTEGFGPEREGIITIESQDGGPFPQLGSRAGLFQHPLQSEYSSITTTHTSATEPFLVDGLTLGAQHLEAGGSLTRHVTQEFVSRTLTTSGTLSTHMDQQFFQT

SEQ ID NO: 96 - protein, 1822 aa, Homo sapiens
MAGPRPSPWARLLLAALISVSLSGTLANRCKKAPVKSCTECVRVDKDCAYCTDEMFRDRRCNTQAELLAAGCQRESIVVMESSFQITEETQIDTTLRRSQMSPQGLRVRLRPGEERHFELEVFEPLESPVDLYILMDFSNSMSDDLDNLKKMGQNLARVLSQLTSDYTIGFGKFVDKVSVPQTDMRPEKLKEPWPNSDPPFSFKNVISLTEDVDEFRNKLQGERISGNLDAPEGGFDAILQTAVCTRDIGWRPDSTHLLVFSTESAFHYEADGANVLAGIMSRNDERCHLDTTGTYTQYRTQDYPSVPTLVRLLAKHNIIPIFAVTNYSYSYYEKLHTYFPVSSLGVLQEDSSNIVELLEEAFNRIRSNLDIRALDSPRGLRTEVTSKMFQKTRTGSFHIRRGEVGIYQVQLRALEHVDGTHVCQLPEDQKGNIHLKPSFSDGLKMDAGIICDVCTCELQKEVRSARCSFNGDFVCGQCVCSEGWSGQTCNCSTGSLSDIQPCLREGEDKPCSGRGECQCGHCVCYGEGRYEGQFCEYDNFQCPRTSGFLCNDRGRCSMGQCVCEPGWTGPSCDCPLSNATCIDSNGGICNGRGHCECGRCHCHQQSLYTDTICEINYSAIHPGLCEDLRSCVQCQAWGTGEKKGRTCEECNFKVKMVDELKRAEEVVVRCSFRDEDDDCTYSYTMEGDGAPGPNSTVLVHKKKDCPPGSFWWLIPLLLLLLPLLALLLLLCWKYCACCKACLALLPCCNRGHMVGFKEDHYMLRENLMASDHLDTPMLRSGNLKGRDVVRWKVTNNMQRPGFATHAASINPTELVPYGLSLRLARLCTENLLKPDTRECAQLRQEVEENLNEVYRQISGVHKLQQTKFRQQPNAGKKQDHTIVDTVLMAPRSAKPALLKLTEKQVEQRAFHDLKVAPGYYTLTADQDARGMVEFQEGVELVDVRVPLFIRPEDDDEKQLLVEAIDVPAGTATLGRRLVNITIIKEQARDVVSFEQPEFSVSRGDQVARIPVIRRVLDGGKSQVSYRTQDGTAQGNRDYIPVEGELLFQPGEAWKELQVKLLELQEVDSLLRGRQVRRFHVQLSNPKFGAHLGQPHSTTIIIRDPDELDRSFTSQMLSSQPPPHGDLGAPQNPNAKAAGSRKIHFNWLPPSGKPMGYRVKYWIQGDSESEAHLLDSKVPSVELTNLYPYCDYEMKVCAYGAQGEGPYSSLVSCRTHQEVPSEPGRLAFNVVSSTVTQLSWAEPAETNGEITAYEVCYGLVNDDNRPIGPMKKVLVDNPKNRMLLIENLRESQPYRYTVKARNGAGWGPEREAIINLATQPKRPMSIPIIPDIPIVDAQSGEDYDSFLMYSDDVLRSPSGSQRPSVSDDTGCGWKFEPLLGEELDLRRVTWRLPPELIPRLSASSGRSSDAEAPTAPRTTAARAGRAAAVPRSATPGPPGEHLVNGRMDFAFPGSTNSLHRMTTTSAAAYGTHLSPHVPHRVLSTSSTLTRDYNSLTRSEHSHSTTLPRDYSTLTSVSSHDSRLTAGVPDTPTRLVFSALGPTSLRVSWQEPRCERPLQGYSVEYQLLNGGELHRLNIPNPAQTSVVVEDLLPNHSYVFRVRAQSQEGWGREREGVITIESQVHPQSPLCPLPGSAFTLSTPSAPGPLVFTALSPDSLQLSWERPRRPNGDIVGYLVTCEMAQGGGPATAFRVDGDSPESRLTVPGLSENVPYKFKVQARTTEGFGPEREGIITIESQDGGPFPQLGSRAGLFQHPLQSEYSSITTTHTSATEPFLVDGLTLGAQHLEAGGSLTRHVTQEFVSRTLTTSGTLSTHMDQQFFQT

SEQ ID NO: 97 - protein, 754 aa, Homo sapiens
MQGADHLHLTPSHRLSLVPYGLSLRLARLCTENLLKPDTRECAQLRQEVEENLNEVYRQISGVHKLQQTKFRQQPNAGKKQDHTIVDTVLMAPRSAKPALLKLTEKQVEQRAFHDLKVAPGYYTLTADQDARGMVEFQEGVELVDVRVPLFIRPEDDDEKQLLVEAIDVPAGTATLGRRLVNITIIKEQARDVVSFEQPEFSVSRGDQVARIPVIRRVLDGGKSQVSYRTQDGTAQGNRDYIPVEGELLFQPGEAWKELQVKLLELQEVDSLLRGRQVRRFHVQLSNPKFGAHLGQPHSTTIIIRDPDELDRSFTSQMLSSQPPPHGDLGAPQNPNAKAAGSRKIHFNWLPPSGKPMGYRVKYWIQGDSESEAHLLDSKVPSVELTNLYPYCDYEMKVCAYGAQGEGPYSSLVSCRTHQEVPSEPGRLAFNVVSSTVTQLSWAEPAETNGEITAYEVCYGLVNDDNRPIGPMKKVLVDNPKNRMLLIENLRESQPYRYTVKARNGAGWGPEREAIINLATQPKRPMSIPIIPDIPIVDAQSGEDYDSFLMYSDDVLRSPSGSQRPSVSDDTEHLVNGRMDFAFPGSTNSLHRMTTTSAAAYGTHLSPHVPHRVLSTSSTLTRDYNSLTRSEHSHSTTLPRDYSTLTSVSSHGLPPIWEHGRSRLPLSWALGSRSRAQMKGFPPSRGPRDSIILAGRPAAPSWGPDSRLTAGVPDTPTRLVFSALGPTSLRVSWQEPRCERPLQGYSVEYQLLNG

SEQ ID NO: 98 - protein, 1875 aa, Homo sapiens
MAGPRPSPWARLLLAALISVSLSGTLANRCKKAPVKSCTECVRVDKDCAYCTDEMFRDRRCNTQAELLAAGCQRESIVVMESSFQITEETQIDTTLRRSQMSPQGLRVRLRPGEERHFELEVFEPLESPVDLYILMDFSNSMSDDLDNLKKMGQNLARVLSQLTSDYTIGFGKFVDKVSVPQTDMRPEKLKEPWPNSDPPFSFKNVISLTEDVDEFRNKLQGERISGNLDAPEGGFDAILQTAVCTRDIGWRPDSTHLLVFSTESAFHYEADGANVLAGIMSRNDERCHLDTTGTYTQYRTQDYPSVPTLVRLLAKHNIIPIFAVTNYSYSYYEKLHTYFPVSSLGVLQEDSSNIVELLEEAFNRIRSNLDIRALDSPRGLRTEVTSKMFQKTRTGSFHIRRGEVGIYQVQLRALEHVDGTHVCQLPEDQKGNIHLKPSFSDGLKMDAGIICDVCTCELQKEVRSARCSFNGDFVCGQCVCSEGWSGQTCNCSTGSLSDIQPCLREGEDKPCSGRGECQCGHCVCYGEGRYEGQFCEYDNFQCPRTSGFLCNDRGRCSMGQCVCEPGWTGPSCDCPLSNATCIDSNGGICNGRGHCECGRCHCHQQSLYTDTICEINYSAIHPGLCEDLRSCVQCQAWGTGEKKGRTCEECNFKVKMVDELKRAEEVVVRCSFRDEDDDCTYSYTMEGDGAPGPNSTVLVHKKKDCPPGSFWWLIPLLLLLLPLLALLLLLCWKYCACCKACLALLPCCNRGHMVGFKEDHYMLRENLMASDHLDTPMLRSGNLKGRDVVRWKVTNNMQRPGFATHAASINPTELVPYGLSLRLARLCTENLLKPDTRECAQLRQEVEENLNEVYRQISGVHKLQQTKFRQQPNAGKKQDHTIVDTVLMAPRSAKPALLKLTEKQVEQRAFHDLKVAPGYYTLTADQDARGMVEFQEGVELVDVRVPLFIRPEDDDEKQLLVEAIDVPAGTATLGRRLVNITIIKEQARDVVSFEQPEFSVSRGDQVARIPVIRRVLDGGKSQVSYRTQDGTAQGNRDYIPVEGELLFQPGEAWKELQVKLLELQEVDSLLRGRQVRRFHVQLSNPKFGAHLGQPHSTTIIIRDPDELDRSFTSQMLSSQPPPHGDLGAPQNPNAKAAGSRKIHFNWLPPSGKPMGYRVKYWIQGDSESEAHLLDSKVPSVELTNLYPYCDYEMKVCAYGAQGEGPYSSLVSCRTHQEVPSEPGRLAFNVVSSTVTQLSWAEPAETNGEITAYEVCYGLVNDDNRPIGPMKKVLVDNPKNRMLLIENLRESQPYRYTVKARNGAGWGPEREAIINLATQPKRPMSIPIIPDIPIVDAQSGEDYDSFLMYSDDVLRSPSGSQRPSVSDDTGCGWKFEPLLGEELDLRRVTWRLPPELIPRLSASSGRSSDAEAPHGPPDDGGAGGKGGSLPRSATPGPPGEHLVNGRMDFAFPGSTNSLHRMTTTSAAAYGTHLSPHVPHRVLSTSSTLTRDYNSLTRSEHSHSTTLPRDYSTLTSVSSHGLPPIWEHGRSRLPLSWALGSRSRAQMKGFPPSRGPRDSIILAGRPAAPSWGPDSRLTAGVPDTPTRLVFSALGPTSLRVSWQEPRCERPLQGYSVEYQLLNGGELHRLNIPNPAQTSVVVEDLLPNHSYVFRVRAQSQEGWGREREGVITIESQVHPQSPLCPLPGSAFTLSTPSAPGPLVFTALSPDSLQLSWERPRRPNGDIVGYLVTCEMAQGGGPATAFRVDGDSPESRLTVPGLSENVPYKFKVQARTTEGFGPEREGIITIESQDGGPFPQLGSRAGLFQHPLQSEYSSITTTHTSATEPFLVDGLTLGAQHLEAGGSLTRHVTQEFVSRTLTTSGTLSTHMDQQFFQT

SEQ ID NO: 99 - protein, 1805 aa, Homo sapiens
MAGPRPSPWARLLLAALISVSLSGTLANRCKKAPVKSCTECVRVDKDCAYCTDEMFRDRRCNTQAELLAAGCQRESIVVMESSFQITEETQIDTTLRRSQMSPQGLRVRLRPGEERHFELEVFEPLESPVDLYILMDFSNSMSDDLDNLKKMGQNLARVLSQLTSDYTIGFGKFVDKVSVPQTDMRPEKLKEPWPNSDPPFSFKNVISLTEDVDEFRNKLQGERISGNLDAPEGGFDAILQTAVCTRDIGWRPDSTHLLVFSTESAFHYEADGANVLAGIMSRNDERCHLDTTGTYTQYRTQDYPSVPTLVRLLAKHNIIPIFAVTNYSYSYYEKLHTYFPVSSLGVLQEDSSNIVELLEEAFNRIRSNLDIRALDSPRGLRTEVTSKMFQKTRTGSFHIRRGEVGIYQVQLRALEHVDGTHVCQLPEDQKGNIHLKPSFSDGLKMDAGIICDVCTCELQKEVRSARCSFNGDFVCGQCVCSEGWSGQTCNCSTGSLSDIQPCLREGEDKPCSGRGECQCGHCVCYGEGRYEGQFCEYDNFQCPRTSGFLCNDRGRCSMGQCVCEPGWTGPSCDCPLSNATCIDSNGGICNGRGHCECGRCHCHQQSLYTDTICEINYSAIHPGLCEDLRSCVQCQAWGTGEKKGRTCEECNFKVKMVDELKRAEEVVVRCSFRDEDDDCTYSYTMEGDGAPGPNSTVLVHKKKDCPPGSFWWLIPLLLLLLPLLALLLLLCWKYCACCKACLALLPCCNRGHMVGFKEDHYMLRENLMASDHLDTPMLRSGNLKGRDVVRWKVTNNMQRPGFATHAASINPTELVPYGLSLRLARLCTENLLKPDTRECAQLRQEVEENLNEVYRQISGVHKLQQTKFRQQPNAGKKQDHTIVDTVLMAPRSAKPALLKLTEKQVEQRAFHDLKVAPGYYTLTADQDARGMVEFQEGVELVDVRVPLFIRPEDDDEKQLLVEAIDVPAGTATLGRRLVNITIIKEQARDVVSFEQPEFSVSRGDQVARIPVIRRVLDGGKSQVSYRTQDGTAQGNRDYIPVEGELLFQPGEAWKELQVKLLELQEVDSLLRGRQVRRFHVQLSNPKFGAHLGQPHSTTIIIRDPDELDRSFTSQMLSSQPPPHGDLGAPQNPNAKAAGSRKIHFNWLPPSGKPMGYRVKYWIQGDSESEAHLLDSKVPSVELTNLYPYCDYEMKVCAYGAQGEGPYSSLVSCRTHQEVPSEPGRLAFNVVSSTVTQLSWAEPAETNGEITAYEVCYGLVNDDNRPIGPMKKVLVDNPKNRMLLIENLRESQPYRYTVKARNGAGWGPEREAIINLATQPKRPMSIPIIPDIPIVDAQSGEDYDSFLMYSDDVLRSPSGSQRPSVSDDTEHLVNGRMDFAFPGSTNSLHRMTTTSAAAYGTHLSPHVPHRVLSTSSTLTRDYNSLTRSEHSHSTTLPRDYSTLTSVSSHGLPPIWEHGRSRLPLSWALGSRSRAQMKGFPPSRGPRDSIILAGRPAAPSWGPDSRLTAGVPDTPTRLVFSALGPTSLRVSWQEPRCERPLQGYSVEYQLLNGGELHRLNIPNPAQTSVVVEDLLPNHSYVFRVRAQSQEGWGREREGVITIESQVHPQSPLCPLPGSAFTLSTPSAPGPLVFTALSPDSLQLSWERPRRPNGDIVGYLVTCEMAQGGGPATAFRVDGDSPESRLTVPGLSENVPYKFKVQARTTEGFGPEREGIITIESQDGGPFPQLGSRAGLFQHPLQSEYSSITTTHTSATEPFLVDGLTLGAQHLEAGGSLTRHVTQEFVSRTLTTSGTLSTHMDQQFFQT

SEQ ID NO: 100 - protein, 974 aa, Homo sapiens [sequence omitted]

SEQ ID NO: 101 - protein, 964 aa, Homo sapiens
MAGPRPSPWARLLLAALISVSLSGTLANRCKKAPVKSCTECVRVDKDCAYCTDEMFRDRRCNTQAELLAAGCQRESIVVMESSFQITEETQIDTTLRRSQMSPQGLRVRLRPGEERHFELEVFEPLESPVDLYILMDFSNSMSDDLDNLKKMGQNLARVLSQLTSDYTIGFGKFVDKVSVPQTDMRPEKLKEPWPNSDPPFSFKNVISLTEDVDEFRNKLQGERISGNLDAPEGGFDAILQTAVCTRDIGWRPDSTHLLVFSTESAFHYEADGANVLAGIMSRNDERCHLDTTGTYTQYRTQDYPSVPTLVRLLAKHNIIPIFAVTNYSYSYYEKLHTYFPVSSLGVLQEDSSNIVELLEEAFNRIRSNLDIRALDSPRGLRTEVTSKMFQKTRTGSFHIRRGEVGIYQVQLRALEHVDGTHVCQLPEDQKGNIHLKPSFSDGLKMDAGIICDVCTCELQKEVRSARCSFNGDFVCGQCVCSEGWSGQTCNCSTGSLSDIQPCLREGEDKPCSGRGECQCGHCVCYGEGRYEGQFCEYDNFQCPRTSGFLCNDRGRCSMGQCVCEPGWTGPSCDCPLSNATCIDSNGGICNGRGHCECGRCHCHQQSLYTDTICEINYSAIHPGLCEDLRSCVQCQAWGTGEKKGRTCEECNFKVKMVDELKRAEEVVVRCSFRDEDDDCTYSYTMEGDGAPGPNSTVLVHKKKDCPPGSFWWLIPLLLLLLPLLALLLLLCWKYCACCKACLALLPCCNRGHMVGFKEDHYMLRENLMASDHLDTPMLRSGNLKGRDVVRWKVTNNMQRPGFATHAASINPTELVPYGLSLRLARLCTENLLKPDTRECAQLRQEVEENVRTQELGLAGDVAERGLQADLRCTQAPADQVPAAAQCREKARPHHCGHSADGAPLGQAGPAEAYREAGGTEGLPRPQGGPRLLHPHCRPGRPGHGGVPGGRGAGGRTGAPLYPA

SEQ ID NO: 102 - protein, 1822 aa, Homo sapiens [sequence omitted]

SEQ ID NO: 103 - DNA, 5648 bp, Homo sapiens
cgcccgcgcgctgcagccccatctcctagcggcagcccaggcgcggagggagcgagtccgccccgaggtaggtccaggacgggcgcacagcagcagccgaggctggccgggagagggaggaagaggatggcagggccacgccccagcccatgggccaggctgctcctggcagccttgatcagcgtcagcctctctgggaccttggcaaaccgctgcaagaaggccccagtgaagagctgcacggagtgtgtccgtgtggataaggactgcgcctactgcacagacgagatgttcagggaccggcgctgcaacacccaggcggagctgctggccgcgggctgccagcgggagagcatcgtggtcatggagagcagcttccaaatcacagaggagacccagattgacaccaccctgcggcgcagccagatgtccccccaaggcctgcgggtccgtctgcggcccggtgaggagcggcattttgagctggaggtgtttgagccactggagagccccgtggacctgtacatcctcatggacttctccaactccatgtccgatgatctggacaacctcaagaagatggggcagaacctggctcgggtcctgagccagctcaccagcgactacactattggatttggcaagtttgtggacaaagtcagcgtcccgcagacggacatgaggcctgagaagctgaaggagccctggcccaacagtgacccccccttctccttcaagaacgtcatcagcctgacagaagatgtggatgagttccggaataaactgcagggagagcggatctcaggcaacctggatgctcctgagggcggcttcgatgccatcctgcagacagctgtgtgcacgagggacattggctggcgcccggacagcacccacctgctggtcttctccaccgagtcagccttccactatgaggctgatggcgccaacgtgctggctggcatcatgagccgcaacgatgaacggtgccacctggacaccacgggcacctacacccagtacaggacacaggactacccgtcggtgcccaccctggtgcgcctgctcgccaagcacaacatcatccccatctttgctgtcaccaactactcctatagctactacgagaagcttcacacctatttccctgtctcctcactgggggtgctgcaggaggactcgtccaacatcgtggagctgctggaggaggccttcaatcggatccgctccaacctggacatccgggccctagacagcccccgaggccttcggacagaggtcacctccaagatgttccagaagacgaggactgggtcctttcacatccggcggggggaagtgggtatataccaggtgcagctgcgggcccttgagcacgtggatgggacgcacgtgtgccagctgccggaggaccagaagggcaacatccatctgaaaccttccttctccgacggcctcaagatggacgcgggcatcatctgtgatgtgtgcacctgcgagctgcaaaaagaggtgcggtcagctcgctgcagcttcaacggagacttcgtgtgcggacagtgtgtgtgcagcgagggctggagtggccagacctgcaactgctccaccggctctctgagtgacattcagccctgcctgcgggagggcgaggacaagccgtgctccggccgtggggagtgccagtgcgggcactgtgtgtgctacggcgaaggccgctacgagggtcagttctgcgagtatgacaacttccagtgtccccgcacttccgggttcctctgcaatgaccgaggacgctgctccatgggccagtgtgtgtgtgagcctggttggacaggcccaagctgtgactgtcccctcagcaatgccacctgcatcgacagcaatgggggcatctgtaatggacgtggccactgtgagtgtggccgctgccactgccaccagcagtcgctctacacggacaccatctgcgagatcaactactcggcgatccacccgggcctctgcgaggacctacgctcctgcgtgcagtgccaggcgtggggcaccggcgagaagaaggggcgcacgtgtgaggaatgcaacttcaaggtcaagatggtggacgagcttaagagagccgaggaggtggtggtgcgctgctccttccgggacgaggatgacgactgcacctacagctacaccatggaaggtgacggcgcccctgggcccaacagcactgtcctggtgcacaagaagaaggactgccctccgggctccttctggtggctcatccccctgctcctcctcctcctgccgctcctggccctgctactgctgctatgctggaagtactgtgcctgctgcaaggcctgcctggcacttctcccgtgctgcaaccgaggtcacatggtgggctttaaggaagaccactacatgctgcgggagaacctgatggcctctgaccacttggacacgcccatgctgcgcagcgggaacctcaagggccgtgacgtggtccgctggaaggtcaccaacaacatgcagcggcctggctttgccactcatgccgccagcatcaaccccacagagctggtgccctacgggctgtccttgcgcctggcccgcctttgcaccgagaacctgctgaagcctgacactcgggagtgcgcccagctgcgccaggaggtggaggagaacctgaacgaggtctacaggcagatctccggtgtacacaagctccagcagaccaagttccggcagcagcccaatgccgggaaaaagcaagaccacaccattgtggacacagtgctgatggcgccccgctcggccaagccggccctgctgaagcttacagagaagcaggtggaacagagggccttccacgacctcaaggtggcccccggctactacaccctcactgcagaccaggacgcccggggcatggtggagttccaggagggcgtggagctggtggacgtacgggtgcccctctttatccggcctgaggatgacgacgagaagcagctgctggtggaggccatcgacgtgcccgcaggcactgccaccctcggccgccgcctggtaaacatcaccatcatcaaggagcaagccagagacgtggtgtcctttgagcagcctgagttctcggtcagccgcggggaccaggtggcccgcatccctgtcatccggcgtgtcctggacggcgggaagtcccaggtctcctaccgcacacaggatggcaccgcgcagggcaaccgggactacatccccgtggagggtgagctgctgttccagcctggggaggcctggaaagagctgcaggtgaagctcctggagctgcaagaagttgactccctcctgcggggccgccaggtccgccgtttccacgtccagctcagcaaccctaagtttggggcccacctgggccagccccactccaccaccatcatcatcagggacccagatgaactggaccggagcttcacgagtcagatgttgtcatcacagccaccccctcacggcgacctgggcgccccgcagaaccccaatgctaaggccgctgggtccaggaagatccatttcaactggctgcccccttctggcaagccaatggggtacagggtaaagtactggattcagggtgactccgaatccgaagcccacctgctcgacagcaaggtgccctcagtggagctcaccaacctgtacccgtattgcgactatgagatgaaggtgtgcgcctacggggctcagggcgagggaccctacagctccctggtgtcctgccgcacccaccaggaagtgcccagcgagccagggcgtctggccttcaatgtcgtctcctccacggtgacccagctgagctgggctgagccggctgagaccaacggtgagatcacagcctacgaggtctgctatggcctggtcaacgatgacaaccgacctattgggcccatgaagaaagtgctggttgacaaccctaagaaccggatgctgcttattgagaaccttcgggagtcccagccctaccgctacacggtgaaggcgcgcaacggggccggctgggggcctgagcgggaggccatcatcaacctggccacccagcccaagaggcccatgtccatccccatcatccctgacatccctatcgtggacgcccagagcggggaggactacgacagcttccttatgtacagcgatgacgttctacgctctccatcgggcagccagaggcccagcgtctccgatgacactgagcacctggtgaatggccggatggactttgccttcccgggcagcaccaactccctgcacaggatgaccacgaccagtgctgctgcctatggcacccacctgagcccacacgtgccccaccgcgtgctaagcacatcctccaccctcacacgggactacaactcactgacccgctcagaacactcacactcgaccacactgccgagggactactccaccctcacctccgtctcctcccacgactctcgcctgactgctggtgtgcccgacacgcccacccgcctggtgttctctgccctggggcccacatctctcagagtgagctggcaggagccgcggtgcgagcggccgctgcagggctacagtgtggagtaccagctgctgaacggcggtgagctgcatcggctcaacatccccaaccctgcccagacctcggtggtggtggaagacctcctgcccaaccactcctacgtgttccgcgtgcgggcccagagccaggaaggctggggccgagagcgtgagggtgtcatcaccattgaatcccaggtgcacccgcagagcccactgtgtcccctgccaggctccgccttcactttgagcactcccagtgccccaggcccgctggtgttcactgccctgagcccagactcgctgcagctgagctgggagcggccacggaggcccaatggggatatcgtcggctacctggtgacctgtgagatggcccaaggaggagggccagccaccgcattccgggtggatggagacagccccgagagccggctgaccgtgccgggcctcagcgagaacgtgccctacaagttcaaggtgcaggccaggaccactgagggcttcgggccagagcgcgagggcatcatcaccatagagtcccaggatggaggacccttcccgcagctgggcagccgtgccgggctcttccagcacccgctgcaaagcgagtacagcagcatcaccaccacccacaccagcgccaccgagcccttcctagtggatgggctgaccctgggggcccagcacctggaggcaggcggctccctcacccggcatgtgacccaggagtttgtgagccggacactgaccaccagcggaacccttagcacccacatggaccaacagttcttccaaacttgaccgcaccctgccccacccccgccacgtcccactaggcgtcctcccgactcctctcccggagcctcctcagctactccatccttgcacccctgggggcccagcccacccgcatgcacagagcaggggctaggtgtctcctgggaggcatgaagggggcaaggtccgtcctctgtgggcccaaacctatttgtaaccaaagagctgggagcagcacaaggacccagcctttgttctgcacttaataaatggttttgctactgcta

SEQ ID NO: 104 - DNA, 5920 bp, Homo sapiens
gccctcggacagtccctgctcgcccgcgcgctgcagccccatctcctagcggcagcccaggcgcggagggagcgagtccgccccgaggaggaagaggatggcagggccacgccccagcccatgggccaggctgctcctggcagccttgatcagcgtcagcctctctgggaccttggcaaaccgctgcaagaaggccccagtgaagagctgcacggagtgtgtccgtgtggataaggactgcgcctactgcacagacgagatgttcagggaccggcgctgcaacacccaggcggagctgctggccgcgggctgccagcgggagagcatcgtggtcatggagagcagcttccaaatcacagaggagacccagattgacaccaccctgcggcgcagccagatgtccccccaaggcctgcgggtccgtctgcggcccggtgaggagcggcattttgagctggaggtgtttgagccactggagagccccgtggacctgtacatcctcatggacttctccaactccatgtccgatgatctggacaacctcaagaagatggggcagaacctggctcgggtcctgagccagctcaccagcgactacactattggatttggcaagtttgtggacaaagtcagcgtcccgcagacggacatgaggcctgagaagctgaaggagccctggcccaacagtgacccccccttctccttcaagaacgtcatcagcctgacagaagatgtggatgagttccggaataaactgcagggagagcggatctcaggcaacctggatgctcctgagggcggcttcgatgccatcctgcagacagctgtgtgcacgagggacattggctggcgcccggacagcacccacctgctggtcttctccaccgagtcagccttccactatgaggctgatggcgccaacgtgctggctggcatcatgagccgcaacgatgaacggtgccacctggacaccacgggcacctacacccagtacaggacacaggactacccgtcggtgcccaccctggtgcgcctgctcgccaagcacaacatcatccccatctttgctgtcaccaactactcctatagctactacgagaagcttcacacctatttccctgtctcctcactgggggtgctgcaggaggactcgtccaacatcgtggagctgctggaggaggccttcaatcggatccgctccaacctggacatccgggccctagacagcccccgaggccttcggacagaggtcacctccaagatgttccagaagacgaggactgggtcctttcacatccggcggggggaagtgggtatataccaggtgcagctgcgggcccttgagcacgtggatgggacgcacgtgtgccagctgccggaggaccagaagggcaacatccatctgaaaccttccttctccgacggcctcaagatggacgcgggcatcatctgtgatgtgtgcacctgcgagctgcaaaaagaggtgcggtcagctcgctgcagcttcaacggagacttcgtgtgcggacagtgtgtgtgcagcgagggctggagtggccagacctgcaactgctccaccggctctctgagtgacattcagccctgcctgcgggagggcgaggacaagccgtgctccggccgtggggagtgccagtgcgggcactgtgtgtgctacggcgaaggccgctacgagggtcagttctgcgagtatgacaacttccagtgtccccgcacttccgggttcctctgcaatgaccgaggacgctgctccatgggccagtgtgtgtgtgagcctggttggacaggcccaagctgtgactgtcccctcagcaatgccacctgcatcgacagcaatgggatccacccgggcctctgcgaggacctacgctcctgcgtgcagtgccaggcgtggggcaccggcgagaagaaggggcgcacgtgtgaggaatgcaacttcaaggtcaagatggtggacgagcttaagagagccgaggaggtggtggtgcgctgctccttccgggacgaggatgacgactgcacctacagctacaccatggaaggtgacggcgcccctgggcccaacagcactgtcctggtgcacaagaagaagggcaccacctccccctgcctcctcctctccagactgccctccgggctccttctggtggctcatccccctgctcctcctcctcctgccgctcctggccctgctactgctgctatgctggaagtactgtgcctgctgcaaggcctgcctggcacttctcccgtgctgcaaccgaggtcacatggtgggctttaaggaagaccactacatgctgcgggagaacctgatggcctctgaccacttggacacgcccatgctgcgcagcgggaacctcaagggccgtgacgtggtccgctggaaggtcaccaacaacatgcagcggcctggctttgccactcatgccgccagcatcaaccccacagagctggtgccctacgggctgtccttgcgcctggcccgcctttgcaccgagaacctgctgaagcctgacactcgggagtgcgcccagctgcgccaggaggtggaggagaacctgaacgaggtctacaggcagatctccggtgtacacaagctccagcagaccaagttccggcagcagcccaatgccgggaaaaagcaagaccacaccattgtggacacagtgctgatggcgccccgctcggccaagccggccctgctgaagcttacagagaagcaggtggaacagagggccttccacgacctcaaggtggcccccggctactacaccctcactgcagaccaggacgcccggggcatggtggagttccaggagggcgtggagctggtggacgtacgggtgcccctctttatccggcctgaggatgacgacgagaagcagctgctggtggaggccatcgacgtgcccgcaggcactgccaccctcggccgccgcctggtaaacatcaccatcatcaaggagcaagccagagacgtggtgtcctttgagcagcctgagttctcggtcagccgcggggaccaggtggcccgcatccctgtcatccggcgtgtcctggacggcgggaagtcccaggtctcctaccgcacacaggatggcaccgcgcagggcaaccgggactacatccccgtggagggtgagctgctgttccagcctggggaggcctggaaagagctgcaggtgaagctcctggagctgcaagaagttgactccctcctgcggggccgccaggtccgccgtttccacgtccagctcagcaaccctaagtttggggcccacctgggccagccccactccaccaccatcatcatcagggacccagatgaactggaccggagcttcacgagtcagatgttgtcatcacagccaccccctcacggcgacctgggcgccccgcagaaccccaatgctaaggccgctgggtccaggaagatccatttcaactggctgcccccttctggcaagccaatggggtacagggtaaagtactggattcagggtgactccgaatccgaagcccacctgctcgacagcaaggtgccctcagtggagctcaccaacctgtacccgtattgcgactatgagatgaaggtgtgcgcctacggggctcagggcgagggaccctacagctccctggtgtcctgccgcacccaccaggaagtgcccagcgagccagggcgtctggccttcaatgtcgtctcctccacggtgacccagctgagctgggctgagccggctgagaccaacggtgagatcacagcctacgaggtctgctatggcctggtcaacgatgacaaccgacctattgggcccatgaagaaagtgctggttgacaaccctaagaaccggatgctgcttattgagaaccttcgggagtcccagccctaccgctacacggtgaaggcgcgcaacggggccggctgggggcctgagcgggaggccatcatcaacctggccacccagcccaagaggcccatgtccatccccatcatccctgacatccctatcgtggacgcccagagcggggaggactacgacagcttccttatgtacagcgatgacgttctacgctctccatcgggcagccagaggcccagcgtctccgatgacactggctgcggctggaagttcgagcccctgctgggggaggagctggacctgcggcgcgtcacgtggcggctgcccccggagctcatcccgcgcctgtcggccagcagcgggcgctcctccgacgccgaggcgccccacgggcccccggacgacggcggcgcgggcgggaagggcggcagcctgccccgcagtgcgacacccgggccccccggagagcacctggtgaatggccggatggactttgccttcccgggcagcaccaactccctgcacaggatgaccacgaccagtgctgctgcctatggcacccacctgagcccacacgtgccccaccgcgtgctaagcacatcctccaccctcacacgggactacaactcactgacccgctcagaacactcacactcgaccacactgccgagggactactccaccctcacctccgtctcctcccacggcctccctcccatctgggaacacgggaggagcaggcttccgctgtcctgggccctggggtcccggagtcgggctcagatgaaagggttccccccttccaggggcccacgagactctataatcctggctgggaggccagcagcgccctcctggggcccagactctcgcctgactgctggtgtgcccgacacgcccacccgcctggtgttctctgccctggggcccacatctctcagagtgagctggcaggagccgcggtgcgagcggccgctgcagggctacagtgtggagtaccagctgctgaacggcggtgagctgcatcggctcaacatccccaaccctgcccagacctcggtggtggtggaagacctcctgcccaaccactcctacgtgttccgcgtgcgggcccagagccaggaaggctggggccgagagcgtgagggtgtcatcaccattgaatcccaggtgcacccgcagagcccactgtgtcccctgccaggctccgccttcactttgagcactcccagtgccccaggcccgctggtgttcactgccctgagcccagactcgctgcagctgagctgggagcggccacggaggcccaatggggatatcgtcggctacctggtgacctgtgagatggcccaaggaggagggccagccaccgcattccgggtggatggagacagccccgagagccggctgaccgtgccgggcctcagcgagaacgtgccctacaagttcaaggtgcaggccaggaccactgagggcttcgggccagagcgcgagggcatcatcaccatagagtcccaggatggaggacccttcccgcagctgggcagccgtgccgggctcttccagcacccgctgcaaagcgagtacagcagcatcaccaccacccacaccagcgccaccgagcccttcctagtggatgggctgaccctgggggcccagcacctggaggcaggcggctccctcacccggcatgtgacccaggagtttgtgagccggacactgaccaccagcggaacccttagcacccacatggaccaacagttcttccaaacttgaccgcaccctgccccacccccgccacgtcccactaggcgtcctcccgactcctctcccggagcctcctcagctactccatccttgcacccctgggggcccagcccacccgcatgcacagagcaggggctaggtgtctcctgggaggcatgaagggggcaaggtccgtcctctgtgggcccaaacctatttgtaaccaaagagctgggagcagcacaaggacccagcctttgttctgcacttaataaatggttttgctactgcta

SEQ ID NO: 105 - DNA, 5829 bp, Homo sapiens
gccctcggacagtccctgctcgcccgcgcgctgcagccccatctcctagcggcagcccaggcgcggagggagcgagtccgccccgaggaggaagaggatggcagggccacgccccagcccatgggccaggctgctcctggcagccttgatcagcgtcagcctctctgggaccttggcaaaccgctgcaagaaggccccagtgaagagctgcacggagtgtgtccgtgtggataaggactgcgcctactgcacagacgagatgttcagggaccggcgctgcaacacccaggcggagctgctggccgcgggctgccagcgggagagcatcgtggtcatggagagcagcttccaaatcacagaggagacccagattgacaccaccctgcggcgcagccagatgtccccccaaggcctgcgggtccgtctgcggcccggtgaggagcggcattttgagctggaggtgtttgagccactggagagccccgtggacctgtacatcctcatggacttctccaactccatgtccgatgatctggacaacctcaagaagatggggcagaacctggctcgggtcctgagccagctcaccagcgactacactattggatttggcaagtttgtggacaaagtcagcgtcccgcagacggacatgaggcctgagaagctgaaggagccctggcccaacagtgacccccccttctccttcaagaacgtcatcagcctgacagaagatgtggatgagttccggaataaactgcagggagagcggatctcaggcaacctggatgctcctgagggcggcttcgatgccatcctgcagacagctgtgtgcacgagggacattggctggcgcccggacagcacccacctgctggtcttctccaccgagtcagccttccactatgaggctgatggcgccaacgtgctggctggcatcatgagccgcaacgatgaacggtgccacctggacaccacgggcacctacacccagtacaggacacaggactacccgtcggtgcccaccctggtgcgcctgctcgccaagcacaacatcatccccatctttgctgtcaccaactactcctatagctactacgagaagcttcacacctatttccctgtctcctcactgggggtgctgcaggaggactcgtccaacatcgtggagctgctggaggaggccttcaatcggatccgctccaacctggacatccgggccctagacagcccccgaggccttcggacagaggtcacctccaagatgttccagaagacgaggactgggtcctttcacatccggcggggggaagtgggtatataccaggtgcagctgcgggcccttgagcacgtggatgggacgcacgtgtgccagctgccggaggaccagaagggcaacatccatctgaaaccttccttctccgacggcctcaagatggacgcgggcatcatctgtgatgtgtgcacctgcgagctgcaaaaagaggtgcggtcagctcgctgcagcttcaacggagacttcgtgtgcggacagtgtgtgtgcagcgagggctggagtggccagacctgcaactgctccaccggctctctgagtgacattcagccctgcctgcgggagggcgaggacaagccgtgctccggccgtggggagtgccagtgcgggcactgtgtgtgctacggcgaaggccgctacgagggtcagttctgcgagtatgacaacttccagtgtccccgcacttccgggttcctctgcaatgaccgaggacgctgctccatgggccagtgtgtgtgtgagcctggttggacaggcccaagctgtgactgtcccctcagcaatgccacctgcatcgacagcaatgggggcatctgtaatggacgtggccactgtgagtgtggccgctgccactgccaccagcagtcgctctacacggacaccatctgcgagatcaactactcggcgatccacccgggcctctgcgaggacctacgctcctgcgtgcagtgccaggcgtggggcaccggcgagaagaaggggcgcacgtgtgaggaatgcaacttcaaggtcaagatggtggacgagcttaagagagccgaggaggtggtggtgcgctgctccttccgggacgaggatgacgactgcacctacagctacaccatggaaggtgacggcgcccctgggcccaacagcactgtcctggtgcacaagaagaaggactgccctccgggctccttctggtggctcatccccctgctcctcctcctcctgccgctcctggccctgctactgctgctatgctggaagtactgtgcctgctgcaaggcctgcctggcacttctcccgtgctgcaaccgaggtcacatggtgggctttaaggaagaccactacatgctgcgggagaacctgatggcctctgaccacttggacacgcccatgctgcgcagcgggaacctcaagggccgtgacgtggtccgctggaaggtcaccaacaacatgcagcggcctggctttgccactcatgccgccagcatcaaccccacagagctggtgccctacgggctgtccttgcgcctggcccgcctttgcaccgagaacctgctgaagcctgacactcgggagtgcgcccagctgcgccaggaggtggaggagaacctgaacgaggtctacaggcagatctccggtgtacacaagctccagcagaccaagttccggcagcagcccaatgccgggaaaaagcaagaccacaccattgtggacacagtgctgatggcgccccgctcggccaagccggccctgctgaagcttacagagaagcaggtggaacagagggccttccacgacctcaaggtggcccccggctactacaccctcactgcagaccaggacgcccggggcatggtggagttccaggagggcgtggagctggtggacgtacgggtgcccctctttatccggcctgaggatgacgacgagaagcagctgctggtggaggccatcgacgtgcccgcaggcactgccaccctcggccgccgcctggtaaacatcaccatcatcaaggagcaagccagagacgtggtgtcctttgagcagcctgagttctcggtcagccgcggggaccaggtggcccgcatccctgtcatccggcgtgtcctggacggcgggaagtcccaggtctcctaccgcacacaggatggcaccgcgcagggcaaccgggactacatccccgtggagggtgagctgctgttccagcctggggaggcctggaaagagctgcaggtgaagctcctggagctgcaagaagttgactccctcctgcggggccgccaggtccgccgtttccacgtccagctcagcaaccctaagtttggggcccacctgggccagccccactccaccaccatcatcatcagggacccagatgaactggaccggagcttcacgagtcagatgttgtcatcacagccaccccctcacggcgacctgggcgccccgcagaaccccaatgctaaggccgctgggtccaggaagatccatttcaactggctgcccccttctggcaagccaatggggtacagggtaaagtactggattcagggtgactccgaatccgaagcccacctgctcgacagcaaggtgccctcagtggagctcaccaacctgtacccgtattgcgactatgagatgaaggtgtgcgcctacggggctcagggcgagggaccctacagctccctggtgtcctgccgcacccaccaggaagtgcccagcgagccagggcgtctggccttcaatgtcgtctcctccacggtgacccagctgagctgggctgagccggctgagaccaacggtgagatcacagcctacgaggtctgctatggcctggtcaacgatgacaaccgacctattgggcccatgaagaaagtgctggttgacaaccctaagaaccggatgctgcttattgagaaccttcgggagtcccagccctaccgctacacggtgaaggcgcgcaacggggccggctgggggcctgagcgggaggccatcatcaacctggccacccagcccaagaggcccatgtccatccccatcatccctgacatccctatcgtggacgcccagagcggggaggactacgacagcttccttatgtacagcgatgacgttctacgctctccatcgggcagccagaggcccagcgtctccgatgacactggctgcggctggaagttcgagcccctgctgggggaggagctggacctgcggcgcgtcacgtggcggctgcccccggagctcatcccgcgcctgtcggccagcagcgggcgctcctccgacgccgaggcgccccacgggcccccggacgacggcggcgcgggcgggaagggcggcagcctgccccgcagtgcgacacccgggccccccggagagcacctggtgaatggccggatggactttgccttcccgggcagcaccaactccctgcacaggatgaccacgaccagtgctgctgcctatggcacccacctgagcccacacgtgccccaccgcgtgctaagcacatcctccaccctcacacgggactacaactcactgacccgctcagaacactcacactcgaccacactgccgagggactactccaccctcacctccgtctcctcccacgactctcgcctgactgctggtgtgcccgacacgcccacccgcctggtgttctctgccctggggcccacatctctcagagtgagctggcaggagccgcggtgcgagcggccgctgcagggctacagtgtggagtaccagctgctgaacggcggtgagctgcatcggctcaacatccccaaccctgcccagacctcggtggtggtggaagacctcctgcccaaccactcctacgtgttccgcgtgcgggcccagagccaggaaggctggggccgagagcgtgagggtgtcatcaccattgaatcccaggtgcacccgcagagcccactgtgtcccctgccaggctccgccttcactttgagcactcccagtgccccaggcccgctggtgttcactgccctgagcccagactcgctgcagctgagctgggagcggccacggaggcccaatggggatatcgtcggctacctggtgacctgtgagatggcccaaggaggagggccagccaccgcattccgggtggatggagacagccccgagagccggctgaccgtgccgggcctcagcgagaacgtgccctacaagttcaaggtgcaggccaggaccactgagggcttcgggccagagcgcgagggcatcatcaccatagagtcccaggatggaggacccttcccgcagctgggcagccgtgccgggctcttccagcacccgctgcaaagcgagtacagcagcatcaccaccacccacaccagcgccaccgagcccttcctagtggatgggctgaccctgggggcccagcacctggaggcaggcggctccctcacccggcatgtgacccaggagtttgtgagccggacactgaccaccagcggaacccttagcacccacatggaccaacagttcttccaaacttgaccgcaccctgccccacccccgccacgtcccactaggcgtcctcccgactcctctcccggagcctcctcagctactccatccttgcacccctgggggcccagcccacccgcatgcacagagcaggggctaggtgtctcctgggaggcatgaagggggcaaggtccgtcctctgtgggcccaaacctatttgtaaccaaagagctgggagcagcacaaggacccagcctttgttctgcacttaataaatggttttgctactgcta

SEQ ID NO: 106 - DNA, 5920 bp, Homo sapiens; identical to SEQ ID NO: 104

SEQ ID NO: 107 - DNA, 5469 bp, Homo sapiens
gccctcggacagtccctgctcgcccgcgcgctgcagccccatctcctagcggcagcccaggcgcggagggagcgagtccgccccgaggaggaagaggatggcagggccacgccccagcccatgggccaggctgctcctggcagccttgatcagcgtcagcctctctgggaccttggcaaaccgctgcaagaaggccccagtgaagagctgcacggagtgtgtccgtgtggataaggactgcgcctactgcacagacgagatgttcagggaccggcgctgcaacacccaggcggagctgctggccgcgggctgccagcgggagagcatcgtggtcatggagagcagcttccaaatcacagaggagacccagattgacaccaccctgcggcgcagccagatgtccccccaaggcctgcgggtccgtctgcggcccggtgaggagcggcattttgagctggaggtgtttgagccactggagagccccgtggacctgtacatcctcatggacttctccaactccatgtccgatgatctggacaacctcaagaagatggggcagaacctggctcgggtcctgagccagctcaccagcgactacactattggatttggcaagtttgtggacaaagtcagcgtcccgcagacggacatgaggcctgagaagctgaaggagccctggcccaacagtgacccccccttctccttcaagaacgtcatcagcctgacagaagatgtggatgagttccggaataaactgcagggagagcggatctcaggcaacctggatgctcctgagggcggcttcgatgccatcctgcagacagctgtgtgcacgagggacattggctggcgcccggacagcacccacctgctggtcttctccaccgagtcagccttccactatgaggctgatggcgccaacgtgctggctggcatcatgagccgcaacgatgaacggtgccacctggacaccacgggcacctacacccagtacaggacacaggactacccgtcggtgcccaccctggtgcgcctgctcgccaagcacaacatcatccccatctttgctgtcaccaactactcctatagctactacgagaagcttcacacctatttccctgtctcctcactgggggtgctgcaggaggactcgtccaacatcgtggagctgctggaggaggccttcaatcggatccgctccaacctggacatccgggccctagacagcccccgaggccttcggacagaggtcacctccaagatgttccagaagacgaggactgggtcctttcacatccggcggggggaagtgggtatataccaggtgcagctgcgggcccttgagcacgtggatgggacgcacgtgtgccagctgccggaggaccagaagggcaacatccatctgaaaccttccttctccgacggcctcaagatggacgcgggcatcatctgtgatgtgtgcacctgcgagctgcaaaaagaggtgcggtcagctcgctgcagcttcaacggagacttcgtgtgcggacagtgtgtgtgcagcgagggctggagtggccagacctgcaactgctccaccggctctctgagtgacattcagccctgcctgcgggagggcgaggacaagccgtgctccggccgtggggagtgccagtgcgggcactgtgtgtgctacggcgaaggccgctacgagggtcagttctgcgagtatgacaacttccagtgtccccgcacttccgggttcctctgcaatgaccgaggacgctgctccatgggccagtgtgtgtgtgagcctggttggacaggcccaagctgtgactgtcccctcagcaatgccacctgcatcgacagcaatgggggcatctgtaatggacgtggccactgtgagtgtggccgctgccactgccaccagcagtcgctctacacggacaccatctgcgagatcaactactcggcgatccacccgggcctctgcgaggacctacgctcctgcgtgcagtgccaggcgtggggcaccggcgagaagaaggggcgcacgtgtgaggaatgcaacttcaaggtcaagatggtggacgagcttaagagagccgaggaggtggtggtgcgctgctccttccgggacgaggatgacgactgcacctacagctacaccatggaaggtgacggcgcccctgggcccaacagcactgtcctggtgcacaagaagaaggactgccctccgggctccttctggtggctcatccccctgctcctcctcctcctgccgctcctggccctgctactgctgctatgctggaagtactgtgcctgctgcaaggcctgcctggcacttctcccgtgctgcaaccgaggtcacatggtgggctttaaggaagaccactacatgctgcgggagaacctgatggcctctgaccacttggacacgcccatgctgcgcagcgggaacctcaagggccgtgacgtggtccgctggaaggtcaccaacaacatgcagcggcctggctttgccactcatgccgccagcatcaaccccacagagctggtgccctacgggctgtccttgcgcctggcccgcctttgcaccgagaacctgctgaagcctgacactcgggagtgcgcccagctgcgccaggaggtggaggagaacctgaacgaggtctacaggcagatctccggtgtacacaagctccagcagaccaagttccggcagcagcccaatgccgggaaaaagcaagaccacaccattgtggacacagtgctgatggcgccccgctcggccaagccggccctgctgaagcttacagagaagcaggtggaacagagggccttccacgacctcaaggtggcccccggctactacaccctcactgcagaccaggacgcccggggcatggtggagttccaggagggcgtggagctggtggacgtacgggtgcccctctttatccggcctgaggatgacgacgagaagcagctgctggtggaggccatcgacgtgcccgcaggcactgccaccctcggccgccgcctggtaaacatcaccatcatcaaggagcaagccagagacgtggtgtcctttgagcagcctgagttctcggtcagccgcggggaccaggtggcccgcatccctgtcatccggcgtgtcctggacggcgggaagtcccaggtctcctaccgcacacaggatggcaccgcgcagggcaaccgggactacatccccgtggagggtgagctgctgttccagcctggggaggcctggaaagagctgcaggtgaagctcctggagctgcaagaagttgactccctcctgcggggccgccaggtccgccgtttccacgtccagctcagcaaccctaagtttggggcccacctgggccagccccactccaccaccatcatcatcagggacccagatgaactggaccggagcttcacgagtcagatgttgtcatcacagccaccccctcacggcgacctgggcgccccgcagaaccccaatgctaaggccgctgggtccaggaagatccatttcaactggctgcccccttctggcaagccaatggggtacagggtaaagtactggattcagggtgactccgaatccgaagcccacctgctcgacagcaaggtgccctcagtggagctcaccaacctgtacccgtattgcgactatgagatgaaggtgtgcgcctacggggctcagggcgagggaccctacagctccctggtgtcctgccgcacccaccaggaagtgcccagcgagccagggcgtctggccttcaatgtcgtctcctccacggtgacccagctgagctgggctgagccggctgagaccaacggtgagatcacagcctacgaggtctgctatggcctggtcaacgatgacaaccgacctattgggcccatgaagaaagtgctggttgacaaccctaagaaccggatgctgcttattgagaaccttcgggagtcccagccctaccgctacacggtgaaggcgcgcaacggggccggctgggggcctgagcgggaggccatcatcaacctggccacccagcccaagaggcccatgtccatccccatcatccctgacatccctatcgtggacgcccagagcggggaggactacgacagcttccttatgtacagcgatgacgttctacgctctccatcgggcagccagaggcccagcgtctccgatgacactgagcacctggtgaatggccggatggactttgccttcccgggcagcaccaactccctgcacaggatgaccacgaccagtgctgctgcctatggcacccacctgagcccacacgtgccccaccgcgtgctaagcacatcctccaccctcacacgggactacaactcactgacccgctcagaacactcacactcgaccacactgccgagggactactccaccctcacctccgtctcctcccacggtgagctgcatcggctcaacatccccaaccctgcccagacctcggtggtggtggaagacctcctgcccaaccactcctacgtgttccgcgtgcgggcccagagccaggaaggctggggccgagagcgtgagggtgtcatcaccattgaatcccaggtgcacccgcagagcccactgtgtcccctgccaggctccgccttcactttgagcactcccagtgccccaggcccgctggtgttcactgccctgagcccagactcgctgcagctgagctgggagcggccacggaggcccaatggggatatcgtcggctacctggtgacctgtgagatggcccaaggaggagggccagccaccgcattccgggtggatggagacagccccgagagccggctgaccgtgccgggcctcagcgagaacgtgccctacaagttcaaggtgcaggccaggaccactgagggcttcgggccagagcgcgagggcatcatcaccatagagtcccaggatggaggacccttcccgcagctgggcagccgtgccgggctcttccagcacccgctgcaaagcgagtacagcagcatcaccaccacccacaccagcgccaccgagcccttcctagtggatgggctgaccctgggggcccagcacctggaggcaggcggctccctcacccggcatgtgacccaggagtttgtgagccggacactgaccaccagcggaacccttagcacccacatggaccaacagttcttccaaacttgaccgcaccctgccccacccccgccacgtcccactaggcgtcctcccgactcctctcccggagcctcctcagctactccatccttgcacccctgggggcccagcccacccgcatgcacagagcaggggctaggtgtctcctgggaggcatgaagggggcaaggtccgtcctctgtgggcccaaacctatttgtaaccaaagagctgggagcagcacaaggacccagcctttgttctgcacttaataaatggttttgctactgcta

SEQ ID NO: 108 - DNA, 5829 bp, Homo sapiens; identical to SEQ ID NO: 105

SEQ ID NO: 109 - DNA, 3377 bp, Homo sapiens
ggctgaggcaggagaattgcttgaacctgggaggtagaggttgcagtgagccgcgatcgtgccactgcattccagcctgggcaacagagcgagaccctgtctcaaaaaaaaaaaaaagaaaagaaacaagtttcttctctgcaggacttctcagaggctttgataaagtcctgtgcctaacctgcaagaggggcatggggaatgaattcagtgcttcccaagtgaacctgaccacagaacctttacagagcacccggcaggatgagagttccacggcgcaaactttgggaaccctctgcccccatccccctctatgcccttgtgtgccatgcttacaccctgctaccacctggatattctggtgtctggggaggcactgtcacccctcttgaccattggcatggggcggggtggctggaagggcttacctgggccagggcagctgtctcaggcctcaccctcacccaccttgtctcctaggcctgcctggcacttctcccgtgctgcaaccgaggtatgggcctggcatcgcaggggcagcaggggctctgactgctctttctctgagctggggtggagggaagctgaacctggaacggcagaggctggaggctctggggtcccacctgaagaggttgggctgtgcgggtctagggaggggtgccgtgctgaggaccccatcctgcaggtcacatggtgggctttaaggaagaccactacatgctgcgggagaacctgatggcctctgaccacttggacacgcccatgctgcgcagcgggaacctcaagggccgtgacgtggtccgctggaaggtcaccaacaacatgcagcggcctggctttgccactcatgccgccagcatcaaccccacagagctgggtgagggcggggctgggcgccacagctctgggcagtgcccttcgggccctctgttccagatctgggatcacagcatgcctcttctctgggtgtggggtgcaggcacagggctcagccaccttttgccctgtgctgatggtgctatgaacctcatgcctcggtgtgcgtggcctgctggccaggcatcccctgatcctagcatggttgctggagggatgctctgtggtgcctgtcatgcagggggctgaccacctccatctcaccccctcccaccgcctttccttagtgccctacgggctgtccttgcgcctggcccgcctttgcaccgagaacctgctgaagcctgacactcgggagtgcgcccagctgcgccaggaggtggaggagaacctgaacgaggtctacaggcagatctccggtgtacacaagctccagcagaccaagttccggcagcagcccaatgccgggaaaaagcaagaccacaccattgtggacacagtgctgatggcgccccgctcggccaagccggccctgctgaagcttacagagaagcaggtggaacagagggccttccacgacctcaaggtggcccccggctactacaccctcactgcagaccaggacgcccggggcatggtggagttccaggagggcgtggagctggtggacgtacgggtgcccctctttatccggcctgaggatgacgacgagaagcagctgctggtggaggccatcgacgtgcccgcaggcactgccaccctcggccgccgcctggtaaacatcaccatcatcaaggagcaagccagagacgtggtgtcctttgagcagcctgagttctcggtcagccgcggggaccaggtggcccgcatccctgtcatccggcgtgtcctggacggcgggaagtcccaggtctcctaccgcacacaggatggcaccgcgcagggcaaccgggactacatccccgtggagggtgagctgctgttccagcctggggaggcctggaaagagctgcaggtgaagctcctggagctgcaagaagttgactccctcctgcggggccgccaggtccgccgtttccacgtccagctcagcaaccctaagtttggggcccacctgggccagccccactccaccaccatcatcatcagggacccagatgaactggaccggagcttcacgagtcagatgttgtcatcacagccaccccctcacggcgacctgggcgccccgcagaaccccaatgctaaggccgctgggtccaggaagatccatttcaactggctgcccccttctggcaagccaatggggtacagggtaaagtactggattcagggtgactccgaatccgaagcccacctgctcgacagcaaggtgccctcagtggagctcaccaacctgtacccgtattgcgactatgagatgaaggtgtgcgcctacggggctcagggcgagggaccctacagctccctggtgtcctgccgcacccaccaggaagtgcccagcgagccagggcgtctggccttcaatgtcgtctcctccacggtgacccagctgagctgggctgagccggctgagaccaacggtgagatcacagcctacgaggtctgctatggcctggtcaacgatgacaaccgacctattgggcccatgaagaaagtgctggttgacaaccctaagaaccggatgctgcttattgagaaccttcgggagtcccagccctaccgctacacggtgaaggcgcgcaacggggccggctgggggcctgagcgggaggccatcatcaacctggccacccagcccaagaggcccatgtccatccccatcatccctgacatccctatcgtggacgcccagagcggggaggactacgacagcttccttatgtacagcgatgacgttctacgctctccatcgggcagccagaggcccagcgtctccgatgacactgagcacctggtgaatggccggatggactttgccttcccgggcagcaccaactccctgcacaggatgaccacgaccagtgctgctgcctatggcacccacctgagcccacacgtgccccaccgcgtgctaagcacatcctccaccctcacacgggactacaactcactgacccgctcagaacactcacactcgaccacactgccgagggactactccaccctcacctccgtctcctcccacggcctccctcccatctgggaacacgggaggagcaggcttccgctgtcctgggccctggggtcccggagtcgggctcagatgaaagggttccccccttccaggggcccacgagactctataatcctggctgggaggccagcagcgccctcctggggcccagactctcgcctgactgctggtgtgcccgacacgcccacccgcctggtgttctctgccctggggcccacatctctcagagtgagctggcaggagccgcggtgcgagcggccgctgcagggctacagtgtggagtaccagctgctgaacggcg

SEQ ID NO: 110 - DNA, 5988 bp, Homo sapiens
gccctcggacagtccctgctcgcccgcgcgctgcagccccatctcctagcggcagcccaggcgcggagggagcgagtccgccccgaggaggaagaggatggcagggccacgccccagcccatgggccaggctgctcctggcagccttgatcagcgtcagcctctctgggaccttggcaaaccgctgcaagaaggccccagtgaagagctgcacggagtgtgtccgtgtggataaggactgcgcctactgcacagacgagatgttcagggaccggcgctgcaacacccaggcggagctgctggccgcgggctgccagcgggagagcatcgtggtcatggagagcagcttccaaatcacagaggagacccagattgacaccaccctgcggcgcagccagatgtccccccaaggcctgcgggtccgtctgcggcccggtgaggagcggcattttgagctggaggtgtttgagccactggagagccccgtggacctgtacatcctcatggacttctccaactccatgtccgatgatctggacaacctcaagaagatggggcagaacctggctcgggtcctgagccagctcaccagcgactacactattggatttggcaagtttgtggacaaagtcagcgtcccgcagacggacatgaggcctgagaagctgaaggagccctggcccaacagtgacccccccttctccttcaagaacgtcatcagcctgacagaagatgtggatgagttccggaataaactgcagggagagcggatctcaggcaacctggatgctcctgagggcggcttcgatgccatcctgcagacagctgtgtgcacgagggacattggctggcgcccggacagcacccacctgctggtcttctccaccgagtcagccttccactatgaggctgatggcgccaacgtgctggctggcatcatgagccgcaacgatgaacggtgccacctggacaccacgggcacctacacccagtacaggacacaggactacccgtcggtgcccaccctggtgcgcctgctcgccaagcacaacatcatccccatctttgctgtcaccaactactcctatagctactacgagaagcttcacacctatttccctgtctcctcactgggggtgctgcaggaggactcgtccaacatcgtggagctgctggaggaggccttcaatcggatccgctccaacctggacatccgggccctagacagcccccgaggccttcggacagaggtcacctccaagatgttccagaagacgaggactgggtcctttcacatccggcggggggaagtgggtatataccaggtgcagctgcgggcccttgagcacgtggatgggacgcacgtgtgccagctgccggaggaccagaagggcaacatccatctgaaaccttccttctccgacggcctcaagatggacgcgggcatcatctgtgatgtgtgcacctgcgagctgcaaaaagaggtgcggtcagctcgctgcagcttcaacggagacttcgtgtgcggacagtgtgtgtgcagcgagggctggagtggccagacctgcaactgctccaccggctctctgagtgacattcagccctgcctgcgggagggcgaggacaagccgtgctccggccgtggggagtgccagtgcgggcactgtgtgtgctacggcgaaggccgctacgagggtcagttctgcgagtatgacaacttccagtgtccccgcacttccgggttcctctgcaatgaccgaggacgctgctccatgggccagtgtgtgtgtgagcctggttggacaggcccaagctgtgactgtcccctcagcaatgccacctgcatcgacagcaatgggggcatctgtaatggacgtggccactgtgagtgtggccgctgccactgccaccagcagtcgctctacacggacaccatctgcgagatcaactactcggcgatccacccgggcctctgcgaggacctacgctcctgcgtgcagtgccaggcgtggggcaccggcgagaagaaggggcgcacgtgtgaggaatgcaacttcaaggtcaagatggtggacgagcttaagagagccgaggaggtggtggtgcgctgctccttccgggacgaggatgacgactgcacctacagctacaccatggaaggtgacggcgcccctgggcccaacagcactgtcctggtgcacaagaagaaggactgccctccgggctccttctggtggctcatccccctgctcctcctcctcctgccgctcctggccctgctactgctgctatgctggaagtactgtgcctgctgcaaggcctgcctggcacttctcccgtgctgcaaccgaggtcacatggtgggctttaaggaagaccactacatgctgcgggagaacctgatggcctctgaccacttggacacgcccatgctgcgcagcgggaacctcaagggccgtgacgtggtccgctggaaggtcaccaacaacatgcagcggcctggctttgccactcatgccgccagcatcaaccccacagagctggtgccctacgggctgtccttgcgcctggcccgcctttgcaccgagaacctgctgaagcctgacactcgggagtgcgcccagctgcgccaggaggtggaggagaacctgaacgaggtctacaggcagatctccggtgtacacaagctccagcagaccaagttccggcagcagcccaatgccgggaaaaagcaagaccacaccattgtggacacagtgctgatggcgccccgctcggccaagccggccctgctgaagcttacagagaagcaggtggaacagagggccttccacgacctcaaggtggcccccggctactacaccctcactgcagaccaggacgcccggggcatggtggagttccaggagggcgtggagctggtggacgtacgggtgcccctctttatccggcctgaggatgacgacgagaagcagctgctggtggaggccatcgacgtgcccgcaggcactgccaccctcggccgccgcctggtaaacatcaccatcatcaaggagcaagccagagacgtggtgtcctttgagcagcctgagttctcggtcagccgcggggaccaggtggcccgcatccctgtcatccggcgtgtcctggacggcgggaagtcccaggtctcctaccgcacacaggatggcaccgcgcagggcaaccgggactacatccccgtggagggtgagctgctgttccagcctggggaggcctggaaagagctgcaggtgaagctcctggagctgcaagaagttgactccctcctgcggggccgccaggtccgccgtttccacgtccagctcagcaaccctaagtttggggcccacctgggccagccccactccaccaccatcatcatcagggacccagatgaactggaccggagcttcacgagtcagatgttgtcatcacagccaccccctcacggcgacctgggcgccccgcagaaccccaatgctaaggccgctgggtccaggaagatccatttcaactggctgcccccttctggcaagccaatggggtacagggtaaagtactggattcagggtgactccgaatccgaagcccacctgctcgacagcaaggtgccctcagtggagctcaccaacctgtacccgtattgcgactatgagatgaaggtgtgcgcctacggggctcagggcgagggaccctacagctccctggtgtcctgccgcacccaccaggaagtgcccagcgagccagggcgtctggccttcaatgtcgtctcctccacggtgacccagctgagctgggctgagccggctgagaccaacggtgagatcacagcctacgaggtctgctatggcctggtcaacgatgacaaccgacctattgggcccatgaagaaagtgctggttgacaaccctaagaaccggatgctgcttattgagaaccttcgggagtcccagccctaccgctacacggtgaaggcgcgcaacggggccggctgggggcctgagcgggaggccatcatcaacctggccacccagcccaagaggcccatgtccatccccatcatccctgacatccctatcgtggacgcccagagcggggaggactacgacagcttccttatgtacagcgatgacgttctacgctctccatcgggcagccagaggcccagcgtctccgatgacactggctgcggctggaagttcgagcccctgctgggggaggagctggacctgcggcgcgtcacgtggcggctgcccccggagctcatcccgcgcctgtcggccagcagcgggcgctcctccgacgccgaggcgccccacgggcccccggacgacggcggcgcgggcgggaagggcggcagcctgccccgcagtgcgacacccgggccccccggagagcacctggtgaatggccggatggactttgccttcccgggcagcaccaactccctgcacaggatgaccacgaccagtgctgctgcctatggcacccacctgagcccacacgtgccccaccgcgtgctaagcacatcctccaccctcacacgggactacaactcactgacccgctcagaacactcacactcgaccacactgccgagggactactccaccctcacctccgtctcctcccacggcctccctcccatctgggaacacgggaggagcaggcttccgctgtcctgggccctggggtcccggagtcgggctcagatgaaagggttccccccttccaggggcccacgagactctataatcctggctgggaggccagcagcgccctcctggggcccagactctcgcctgactgctggtgtgcccgacacgcccacccgcctggtgttctctgccctggggcccacatctctcagagtgagctggcaggagccgcggtgcgagcggccgctgcagggctacagtgtggagtaccagctgctgaacggcggtgagctgcatcggctcaacatccccaaccctgcccagacctcggtggtggtggaagacctcctgcccaaccactcctacgtgttccgcgtgcgggcccagagccaggaaggctggggccgagagcgtgagggtgtcatcaccattgaatcccaggtgcacccgcagagcccactgtgtcccctgccaggctccgccttcactttgagcactcccagtgccccaggcccgctggtgttcactgccctgagcccagactcgctgcagctgagctgggagcggccacggaggcccaatggggatatcgtcggctacctggtgacctgtgagatggcccaaggaggagggccagccaccgcattccgggtggatggagacagccccgagagccggctgaccgtgccgggcctcagcgagaacgtgccctacaagttcaaggtgcaggccaggaccactgagggcttcgggccagagcgcgagggcatcatcaccatagagtcccaggatggaggacccttcccgcagctgggcagccgtgccgggctcttccagcacccgctgcaaagcgagtacagcagcatcaccaccacccacaccagcgccaccgagcccttcctagtggatgggctgaccctgggggcccagcacctggaggcaggcggctccctcacccggcatgtgacccaggagtttgtgagccggacactgaccaccagcggaacccttagcacccacatggaccaacagttcttccaaacttgaccgcaccctgccccacccccgccacgtcccactaggcgtcctcccgactcctctcccggagcctcctcagctactccatccttgcacccctgggggcccagcccacccgcatgcacagagcaggggctaggtgtctcctgggaggcatgaagggggcaaggtccgtcctctgtgggcccaaacctatttgtaaccaaagagctgggagcagcacaaggacccagcctttgttctgcacttaataaatggttttgctactgcta

SEQ ID NO: 111 - DNA, 5778 bp, Homo sapiens
gccctcggacagtccctgctcgcccgcgcgctgcagccccatctcctagcggcagcccaggcgcggagggagcgagtccgccccgaggaggaagaggatggcagggccacgccccagcccatgggccaggctgctcctggcagccttgatcagcgtcagcctctctgggaccttggcaaaccgctgcaagaaggccccagtgaagagctgcacggagtgtgtccgtgtggataaggactgcgcctactgcacagacgagatgttcagggaccggcgctgcaacacccaggcggagctgctggccgcgggctgccagcgggagagcatcgtggtcatggagagcagcttccaaatcacagaggagacccagattgacaccaccctgcggcgcagccagatgtccccccaaggcctgcgggtccgtctgcggcccggtgaggagcggcattttgagctggaggtgtttgagccactggagagccccgtggacctgtacatcctcatggacttctccaactccatgtccgatgatctggacaacctcaagaagatggggcagaacctggctcgggtcctgagccagctcaccagcgactacactattggatttggcaagtttgtggacaaagtcagcgtcccgcagacggacatgaggcctgagaagctgaaggagccctggcccaacagtgacccccccttctccttcaagaacgtcatcagcctgacagaagatgtggatgagttccggaataaactgcagggagagcggatctcaggcaacctggatgctcctgagggcggcttcgatgccatcctgcagacagctgtgtgcacgagggacattggctggcgcccggacagcacccacctgctggtcttctccaccgagtcagccttccactatgaggctgatggcgccaacgtgctggctggcatcatgagccgcaacgatgaacggtgccacctggacaccacgggcacctacacccagtacaggacacaggactacccgtcggtgcccaccctggtgcgcctgctcgccaagcacaacatcatccccatctttgctgtcaccaactactcctatagctactacgagaagcttcacacctatttccctgtctcctcactgggggtgctgcaggaggactcgtccaacatcgtggagctgctggaggaggccttcaatcggatccgctccaacctggacatccgggccctagacagcccccgaggccttcggacagaggtcacctccaagatgttccagaagacgaggactgggtcctttcacatccggcggggggaagtgggtatataccaggtgcagctgcgggcccttgagcacgtggatgggacgcacgtgtgccagctgccggaggaccagaagggcaacatccatctgaaaccttccttctccgacggcctcaagatggacgcgggcatcatctgtgatgtgtgcacctgcgagctgcaaaaagaggtgcggtcagctcgctgcagcttcaacggagacttcgtgtgcggacagtgtgtgtgcagcgagggctggagtggccagacctgcaactgctccaccggctctctgagtgacattcagccctgcctgcgggagggcgaggacaagccgtgctccggccgtggggagtgccagtgcgggcactgtgtgtgctacggcgaaggccgctacgagggtcagttctgcgagtatgacaacttccagtgtccccgcacttccgggttcctctgcaatgaccgaggacgctgctccatgggccagtgtgtgtgtgagcctggttggacaggcccaagctgtgactgtcccctcagcaatgccacctgcatcgacagcaatgggggcatctgtaatggacgtggccactgtgagtgtggccgctgccactgccaccagcagtcgctctacacggacaccatctgcgagatcaactactcggcgatccacccgggcctctgcgaggacctacgctcctgcgtgcagtgccaggcgtggggcaccggcgagaagaaggggcgcacgtgtgaggaatgcaacttcaaggtcaagatggtggacgagcttaagagagccgaggaggtggtggtgcgctgctccttccgggacgaggatgacgactgcacctacagctacaccatggaaggtgacggcgcccctgggcccaacagcactgtcctggtgcacaagaagaaggactgccctccgggctccttctggtggctcatccccctgctcctcctcctcctgccgctcctggccctgctactgctgctatgctggaagtactgtgcctgctgcaaggcctgcctggcacttctcccgtgctgcaaccgaggtcacatggtgggctttaaggaagaccactacatgctgcgggagaacctgatggcctctgaccacttggacacgcccatgctgcgcagcgggaacctcaagggccgtgacgtggtccgctggaaggtcaccaacaacatgcagcggcctggctttgccactcatgccgccagcatcaaccccacagagctggtgccctacgggctgtccttgcgcctggcccgcctttgcaccgagaacctgctgaagcctgacactcgggagtgcgcccagctgcgccaggaggtggaggagaacctgaacgaggtctacaggcagatctccggtgtacacaagctccagcagaccaagttccggcagcagcccaatgccgggaaaaagcaagaccacaccattgtggacacagtgctgatggcgccccgctcggccaagccggccctgctgaagcttacagagaagcaggtggaacagagggccttccacgacctcaaggtggcccccggctactacaccctcactgcagaccaggacgcccggggcatggtggagttccaggagggcgtggagctggtggacgtacgggtgcccctctttatccggcctgaggatgacgacgagaagcagctgctggtggaggccatcgacgtgcccgcaggcactgccaccctcggccgccgcctggtaaacatcaccatcatcaaggagcaagccagagacgtggtgtcctttgagcagcctgagttctcggtcagccgcggggaccaggtggcccgcatccctgtcatccggcgtgtcctggacggcgggaagtcccaggtctcctaccgcacacaggatggcaccgcgcagggcaaccgggactacatccccgtggagggtgagctgctgttccagcctggggaggcctggaaagagctgcaggtgaagctcctggagctgcaagaagttgactccctcctgcggggccgccaggtccgccgtttccacgtccagctcagcaaccctaagtttggggcccacctgggccagccccactccaccaccatcatcatcagggacccagatgaactggaccggagcttcacgagtcagatgttgtcatcacagccaccccctcacggcgacctgggcgccccgcagaaccccaatgctaaggccgctgggtccaggaagatccatttcaactggctgcccccttctggcaagccaatggggtacagggtaaagtactggattcagggtgactccgaatccgaagcccacctgctcgacagcaaggtgccctcagtggagctcaccaacctgtacccgtattgcgactatgagatgaaggtgtgcgcctacggggctcagggcgagggaccctacagctccctggtgtcctgccgcacccaccaggaagtgcccagcgagccagggcgtctggccttcaatgtcgtctcctccacggtgacccagctgagctgggctgagccggctgagaccaacggtgagatcacagcctacgaggtctgctatggcctggtcaacgatgacaaccgacctattgggcccatgaagaaagtgctggttgacaaccctaagaaccggatgctgcttattgagaaccttcgggagtcccagccctaccgctacacggtgaaggcgcgcaacggggccggctgggggcctgagcgggaggccatcatcaacctggccacccagcccaagaggcccatgtccatccccatcatccctgacatccctatcgtggacgcccagagcggggaggactacgacagcttccttatgtacagcgatgacgttctacgctctccatcgggcagccagaggcccagcgtctccgatgacactgagcacctggtgaatggccggatggactttgccttcccgggcagcaccaactccctgcacaggatgaccacgaccagtgctgctgcctatggcacccacctgagcccacacgtgccccaccgcgtgctaagcacatcctccaccctcacacgggactacaactcactgacccgctcagaacactcacactcgaccacactgccgagggactactccaccctcacctccgtctcctcccacggcctccctcccatctgggaacacgggaggagcaggcttccgctgtcctgggccctggggtcccggagtcgggctcagatgaaagggttccccccttccaggggcccacgagactctataatcctggctgggaggccagcagcgccctcctggggcccagactctcgcctgactgctggtgtgcccgacacgcccacccgcctggtgttctctgccctggggcccacatctctcagagtgagctggcaggagccgcggtgcgagcggccgctgcagggctacagtgtggagtaccagctgctgaacggcggtgagctgcatcggctcaacatccccaaccctgcccagacctcggtggtggtggaagacctcctgcccaaccactcctacgtgttccgcgtgcgggcccagagccaggaaggctggggccgagagcgtgagggtgtcatcaccattgaatcccaggtgcacccgcagagcccactgtgtcccctgccaggctccgccttcactttgagcactcccagtgccccaggcccgctggtgttcactgccctgagcccagactcgctgcagctgagctgggagcggccacggaggcccaatggggatatcgtcggctacctggtgacctgtgagatggcccaaggaggagggccagccaccgcattccgggtggatggagacagccccgagagccggctgaccgtgccgggcctcagcgagaacgtgccctacaagttcaaggtgcaggccaggaccactgagggcttcgggccagagcgcgagggcatcatcaccatagagtcccaggatggaggacccttcccgcagctgggcagccgtgccgggctcttccagcacccgctgcaaagcgagtacagcagcatcaccaccacccacaccagcgccaccgagcccttcctagtggatgggctgaccctgggggcccagcacctggaggcaggcggctccctcacccggcatgtgacccaggagtttgtgagccggacactgaccaccagcggaacccttagcacccacatggaccaacagttcttccaaacttgaccgcaccctgccccacccccgccacgtcccactaggcgtcctcccgactcctctcccggagcctcctcagctactccatccttgcacccctgggggcccagcccacccgcatgcacagagcaggggctaggtgtctcctgggaggcatgaagggggcaaggtccgtcctctgtgggcccaaacctatttgtaaccaaagagctgggagcagcacaaggacccagcctttgttctgcacttaataaatggttttgctactgcta

SEQ ID NO: 112 - DNA, 5866 bp, Homo sapiens
gccctcggacagtccctgctcgcccgcgcgctgcagccccatctcctagcggcagcccaggcgcggagggagcgagtccgccccgaggaggaagaggatggcagggccacgccccagcccatgggccaggctgctcctggcagccttgatcagcgtcagcctctctgggaccttggcaaaccgctgcaagaaggccccagtgaagagctgcacggagtgtgtccgtgtggataaggactgcgcctactgcacagacgagatgttcagggaccggcgctgcaacacccaggcggagctgctggccgcgggctgccagcgggagagcatcgtggtcatggagagcagcttccaaatcacagaggagacccagattgacaccaccctgcggcgcagccagatgtccccccaaggcctgcgggtccgtctgcggcccggtgaggagcggcattttgagctggaggtgtttgagccactggagagccccgtggacctgtacatcctcatggacttctccaactccatgtccgatgatctggacaacctcaagaagatggggcagaacctggctcgggtcctgagccagctcaccagcgactacactattggatttggcaagtttgtggacaaagtcagcgtcccgcagacggacatgaggcctgagaagctgaaggagccctggcccaacagtgacccccccttctccttcaagaacgtcatcagcctgacagaagatgtggatgagttccggaataaactgcagggagagcggatctcaggcaacctggatgctcctgagggcggcttcgatgccatcctgcagacagctgtgtgcacgagggacattggctggcgcccggacagcacccacctgctggtcttctccaccgagtcagccttccactatgaggctgatggcgccaacgtgctggctggcatcatgagccgcaacgatgaacggtgccacctggacaccacgggcacctacacccagtacaggacacaggactacccgtcggtgcccaccctggtgcgcctgctcgccaagcacaacatcatccccatctttgctgtcaccaactactcctatagctactacgagaagcttcacacctatttccctgtctcctcactgggggtgctgcaggaggactcgtccaacatcgtggagctgctggaggaggccttcaatcggatccgctccaacctggacatccgggccctagacagcccccgaggccttcggacagaggtcacctccaagatgttccagaagacgaggactgggtcctttcacatccggcggggggaagtgggtatataccaggtgcagctgcgggcccttgagcacgtggatgggacgcacgtgtgccagctgccggaggaccagaagggcaacatccatctgaaaccttccttctccgacggcctcaagatggacgcgggcatcatctgtgatgtgtgcacctgcgagctgcaaaaagaggtgcggtcagctcgctgcagcttcaacggagacttcgtgtgcggacagtgtgtgtgcagcgagggctggagtggccagacctgcaactgctccaccggctctctgagtgacattcagccctgcctgcgggagggcgaggacaagccgtgctccggccgtggggagtgccagtgcgggcactgtgtgtgctacggcgaaggccgctacgagggtcagttctgcgagtatgacaacttccagtgtccccgcacttccgggttcctctgcaatgaccgaggacgctgctccatgggccagtgtgtgtgtgagcctggttggacaggcccaagctgtgactgtcccctcagcaatgccacctgcatcgacagcaatgggggcatctgtaatggacgtggccactgtgagtgtggccgctgccactgccaccagcagtcgctctacacggacaccatctgcgagatcaactactcggcgatccacccgggcctctgcgaggacctacgctcctgcgtgcagtgccaggcgtggggcaccggcgagaagaaggggcgcacgtgtgaggaatgcaacttcaaggtcaagatggtggacgagcttaagagagccgaggaggtggtggtgcgctgctccttccgggacgaggatgacgactgcacctacagctacaccatggaaggtgacggcgcccctgggcccaacagcactgtcctggtgcacaagaagaaggactgccctccgggctccttctggtggctcatccccctgctcctcctcctcctgccgctcctggccctgctactgctgctatgctggaagtactgtgcctgctgcaaggcctgcctggcacttctcccgtgctgcaaccgaggtcacatggtgggctttaaggaagaccactacatgctgcgggagaacctgatggcctctgaccacttggacacgcccatgctgcgcagcgggaacctcaagggccgtgacgtggtccgctggaaggtcaccaacaacatgcagcggcctggctttgccactcatgccgccagcatcaaccccacagagctggtgccctacgggctgtccttgcgcctggcccgcctttgcaccgagaacctgctgaagcctgacactcgggagtgcgcccagctgcgccaggaggtggaggagaacgtaaggacccaggaactaggcctggccggagatgtggctgaacgaggtctacaggcagatctccggtgtacacaagctccagcagaccaagttccggcagcagcccaatgccgggaaaaagcaagaccacaccattgtggacacagtgctgatggcgccccgctcggccaagccggccctgctgaagcttacagagaagcaggtggaacagagggccttccacgacctcaaggtggcccccggctactacaccctcactgcagaccaggacgcccggggcatggtggagttccaggagggcgtggagctggtggacgtacgggtgcccctctttatccggcctgaggatgacgacgagaagcagctgctggtggaggccatcgacgtgcccgcaggcactgccaccctcggccgccgcctggtaaacatcaccatcatcaaggagcaagccagagacgtggtgtcctttgagcagcctgagttctcggtcagccgcggggaccaggtggcccgcatccctgtcatccggcgtgtcctggacggcgggaagtcccaggtctcctaccgcacacaggatggcaccgcgcagggcaaccgggactacatccccgtggagggtgagctgctgttccagcctggggaggcctggaaagagctgcaggtgaagctcctggagctgcaagaagttgactccctcctgcggggccgccaggtccgccgtttccacgtccagctcagcaaccctaagtttggggcccacctgggccagccccactccaccaccatcatcatcagggacccagatgaactggaccggagcttcacgagtcagatgttgtcatcacagccaccccctcacggcgacctgggcgccccgcagaaccccaatgctaaggccgctgggtccaggaagatccatttcaactggctgcccccttctggcaagccaatggggtacagggtaaagtactggattcagggtgactccgaatccgaagcccacctgctcgacagcaaggtgccctcagtggagctcaccaacctgtacccgtattgcgactatgagatgaaggtgtgcgcctacggggctcagggcgagggaccctacagctccctggtgtcctgccgcacccaccaggaagtgcccagcgagccagggcgtctggccttcaatgtcgtctcctccacggtgacccagctgagctgggctgagccggctgagaccaacggtgagatcacagcctacgaggtctgctatggcctggtcaacgatgacaaccgacctattgggcccatgaagaaagtgctggttgacaaccctaagaaccggatgctgcttattgagaaccttcgggagtcccagccctaccgctacacggtgaaggcgcgcaacggggccggctgggggcctgagcgggaggccatcatcaacctggccacccagcccaagaggcccatgtccatccccatcatccctgacatccctatcgtggacgcccagagcggggaggactacgacagcttccttatgtacagcgatgacgttctacgctctccatcgggcagccagaggcccagcgtctccgatgacactggctgcggctggaagttcgagcccctgctgggggaggagctggacctgcggcgcgtcacgtggcggctgcccccggagctcatcccgcgcctgtcggccagcagcgggcgctcctccgacgccgaggcgccccacgggcccccggacgacggcggcgcgggcgggaagggcggcagcctgccccgcagtgcgacacccgggccccccggagagcacctggtgaatggccggatggactttgccttcccgggcagcaccaactccctgcacaggatgaccacgaccagtgctgctgcctatggcacccacctgagcccacacgtgccccaccgcgtgctaagcacatcctccaccctcacacgggactacaactcactgacccgctcagaacactcacactcgaccacactgccgagggactactccaccctcacctccgtctcctcccacgactctcgcctgactgctggtgtgcccgacacgcccacccgcctggtgttctctgccctggggcccacatctctcagagtgagctggcaggagccgcggtgcgagcggccgctgcagggctacagtgtggagtaccagctgctgaacggcggtgagctgcatcggctcaacatccccaaccctgcccagacctcggtggtggtggaagacctcctgcccaaccactcctacgtgttccgcgtgcgggcccagagccaggaaggctggggccgagagcgtgagggtgtcatcaccattgaatcccaggtgcacccgcagagcccactgtgtcccctgccaggctccgccttcactttgagcactcccagtgccccaggcccgctggtgttcactgccctgagcccagactcgctgcagctgagctgggagcggccacggaggcccaatggggatatcgtcggctacctggtgacctgtgagatggcccaaggaggagggccagccaccgcattccgggtggatggagacagccccgagagccggctgaccgtgccgggcctcagcgagaacgtgccctacaagttcaaggtgcaggccaggaccactgagggcttcgggccagagcgcgagggcatcatcaccatagagtcccaggatggaggacccttcccgcagctgggcagccgtgccgggctcttccagcacccgctgcaaagcgagtacagcagcatcaccaccacccacaccagcgccaccgagcccttcctagtggatgggctgaccctgggggcccagcacctggaggcaggcggctccctcacccggcatgtgacccaggagtttgtgagccggacactgaccaccagcggaacccttagcacccacatggaccaacagttcttccaaacttgaccgcaccctgccccacccccgccacgtcccactaggcgtcctcccgactcctctcccggagcctcctcagctactccatccttgcacccctgggggcccagcccacccgcatgcacagagcaggggctaggtgtctcctgggaggcatgaagggggcaaggtccgtcctctgtgggcccaaacctatttgtaaccaaagagctgggagcagcacaaggacccagcctttgttctgcacttaataaatggttttgctactgcta

SEQ ID NO: 113 - DNA, 5866 bp, Homo sapiens; identical to SEQ ID NO: 112

SEQ ID NO: 114 - DNA, 5829 bp, Homo sapiens; identical to SEQ ID NO: 105

SEQ ID NO: 115 - protein, 411 aa, Homo sapiens
MWSGWWLWPLVAVCTADFFRDEAERIMRDSPVIDGHNDLPWQLLDMFNNRLQDERANLTTLAGTHTNIPKLRAGFVGGQFWSVYTPCDTQNKDAVRRTLEQMDVVHRMCRMYPETFLYVTSSAGIRQAFREGKVASLIGVEGGHSIDSSLGVLRALYQLGMRYLTLTHSCNTPWADNWLVDTGDSEPQSQGLSPFGQRVVKELNRLGVLIDLAHVSVATMKATLQLSRAPVIFSHSSAYSVCASRRNVPDDVLRLVKQTDSLVMVNFYNNYISCTNKANLSQVADHLDHIKEVAGARAVGFGGDFDGVPRVPEGLEDVSKYPDLIAELLRRNWTEAEVKGALADNLLRVFEAVEQASNLTQAPEEEPIPLDQLGGSCRTHYGYSSGASSLHRHWGLLLASLAPLVLCLSLL

SEQ ID NO: 116 - protein, 411 aa, Homo sapiens [sequence omitted]

SEQ ID NO: 117 - DNA, 1767 bp, Homo sapiens
ccctggggtactgtgcgagccctcaaggaggtggctgttctgtagctggagagctccgtgggtggcaggactgaacttgaacaccagaaacaacccccaagccttgtgacctgggaggcaggaggcgggtctgtctccctgggacttgggtggctgagccgaggtactcgggaccctgtcccgcgcatggcagagtggctcctcacagcctgaagctcatccttctgcacgggccagccaggccagcacagaggcaccagggcagcagtgcacacaggtccccggggaccccaccatgtggagcggatggtggctgtggccccttgtggccgtctgcactgcagacttctttcgggacgaggcagagaggatcatgagggactcccctgtcattgatgggcacaatgacctcccctggcagctgctggatatgttcaacaaccggctgcaggacgagagggccaacctgaccaccttggccggcacacacaccaacatccccaagctgagggccggctttgtgggaggccagttctggtccgtgtacacgccctgcgacacccagaacaaagacgccgtgcggaggacgctggagcagatggacgtggtccaccgcatgtgccggatgtacccggagaccttcctgtatgtcaccagcagtgcaggcattcggcaggccttccgggaagggaaggtggccagcctgatcggcgtggagggcggccactccattgacagcagtttgggcgtcctgcgggcactctatcagctgggcatgcggtacctgaccctcacccacagctgcaacacgccctgggctgacaactggctggtggacacgggagacagcgagccccagagccaaggcttgtcaccctttgggcagcgtgtggtgaaggagctgaaccgtctgggggtcctcatcgacttggctcacgtgtctgtggccaccatgaaggccaccctgcagctgtccagagccccggtcatcttcagccactcctcggcctacagcgtgtgcgcaagccggcgcaacgtgcctgacgacgtcctgaggctggtgaaacagacagacagcctggtgatggtgaacttctacaacaattacatttcctgcaccaacaaggccaacctgtcccaagtggccgaccatctggatcacatcaaggaggtggcaggagccagagccgtgggttttggtggggactttgatggtgttccaagggtccctgaggggctggaggacgtctccaagtatccagacctgatcgctgagctgctcaggaggaactggacggaggcggaggtcaagggcgcactggctgacaacctgctgagggtcttcgaggctgtggaacaggccagcaacctcacacaggctcccgaggaggagcccatcccgctggaccagctgggtggctcctgcaggacccattacggctactcctctggggcttccagcctccatcgccactgggggctcctgctggcctccctcgctcccctggtcctctgtctgtctctcctgtgaaacctgggagaccagagtcccctttagggttcccggagctccgggaagacccgcccatcccaggactccagatgccaggagccctgctgcccacatgcaaggaccagcatctcctgagaggacgcctgggcttacctggggggcaggatgcctggggacagttcaggacacacacacagtaggcccgcaataaaagcaacaccccttcacatcctggggtacgtgtcatcggcatc

SEQ ID NO: 118 - DNA, 1677 bp, Homo sapiens
gtggcacatccacacatgagggaaaaacactgccaggacatctcagggcactctcaggaaatgaggaagctgctggagaagtttctagccttggggcaggcagagtggctcctcacagcctgaagctcatccttctgcacgggccagccaggccagcacagaggcaccagggcagcagtgcacacaggtccccggggaccccaccatgtggagcggatggtggctgtggccccttgtggccgtctgcactgcagacttctttcgggacgaggcagagaggatcatgagggactcccctgtcattgatgggcacaatgacctcccctggcagctgctggatatgttcaacaaccggctgcaggacgagagggccaacctgaccaccttggccggcacacacaccaacatccccaagctgagggccggctttgtgggaggccagttctggtccgtgtacacgccctgcgacacccagaacaaagacgccgtgcggaggacgctggagcagatggacgtggtccaccgcatgtgccggatgtacccggagaccttcctgtatgtcaccagcagtgcaggcattcggcaggccttccgggaagggaaggtggccagcctgatcggcgtggagggcggccactccattgacagcagtttgggcgtcctgcgggcactctatcagctgggcatgcggtacctgaccctcacccacagctgcaacacgccctgggctgacaactggctggtggacacgggagacagcgagccccagagccaaggcttgtcaccctttgggcagcgtgtggtgaaggagctgaaccgtctgggggtcctcatcgacttggctcacgtgtctgtggccaccatgaaggccaccctgcagctgtccagagccccggtcatcttcagccactcctcggcctacagcgtgtgcgcaagccggcgcaacgtgcctgacgacgtcctgaggctggtgaaacagacagacagcctggtgatggtgaacttctacaacaattacatttcctgcaccaacaaggccaacctgtcccaagtggccgaccatctggatcacatcaaggaggtggcaggagccagagccgtgggttttggtggggactttgatggtgttccaagggtccctgaggggctggaggacgtctccaagtatccagacctgatcgctgagctgctcaggaggaactggacggaggcggaggtcaagggcgcactggctgacaacctgctgagggtcttcgaggctgtggaacaggccagcaacctcacacaggctcccgaggaggagcccatcccgctggaccagctgggtggctcctgcaggacccattacggctactcctctggggcttccagcctccatcgccactgggggctcctgctggcctccctcgctcccctggtcctctgtctgtctctcctgtgaaacctgggagaccagagtcccctttagggttcccggagctccgggaagacccgcccatcccaggactccagatgccaggagccctgctgcccacatgcaaggaccagcatctcctgagaggacgcctgggcttacctggggggcaggatgcctggggacagttcaggacacacacacagtaggcccgcaataaaagcaacaccccttcacatcctggggtacgtgtcatcggcatc

SEQ ID NO: 119 - protein, 238 aa, Homo sapiens
METPAWPRVPRPETAVARTLLLGWVFAQVAGASGTTNTVAAYNLTWKSTNFKTILEWEPKPVNQVYTVQISTKSGDWKSKCFYTTDTECDLTDEIVKDVKQTYLARVFSYPAGNVESTGSAGEPLYENSPEFTPYLETNLGQPTIQSFEQVGTKVNVTVEDERTLVRRNNTFLSLRDVFGKDLIYTLYYWKSSSSGKKYSTSLELWYLWSSSLSSSWLYLYTSVERQEWGRAGRRTPH

SEQ ID NO: 120 - protein, 295 aa, Homo sapiens
METPAWPRVPRPETAVARTLLLGWVFAQVAGASGTTNTVAAYNLTWKSTNFKTILEWEPKPVNQVYTVQISTKSGDWKSKCFYTTDTECDLTDEIVKDVKQTYLARVFSYPAGNVESTGSAGEPLYENSPEFTPYLETNLGQPTIQSFEQVGTKVNVTVEDERTLVRRNNTFLSLRDVFGKDLIYTLYYWKSSSSGKKTAKTNTNEFLIDVDKGENYCFSVQAVIPSRTVNRKSTDSPVECMGQEKGEFREIFYIIGAVVFVVIILVIILAISLHKCRKAGVGQSWKENSPLNVS

SEQ ID NO: 121 - protein, 220 aa, Homo sapiens
TLLLGWVFAQVAGASGTTNTVAAYNLTWKSTNFKTILEWEPKPVNQVYTVQISTKSGDWKSKCFYTTDTECDLTDEIVKDVKQTYLARVFSYPAGNVESTGSAGEPLYENSPEFTPYLETNLGQPTIQSFEQVGTKVNVTVEDERTLVRRNNTFLSLRDVFGKDLIYTLYYWKSSSSGKKYSTSLELWYLWSSSLSSSWLYLYTSVERQEWGRAGRRTPH

SEQ ID NO: 122 - DNA, 730 bp, Homo sapiens
catggagacccctgcctggccccgggtcccgcgccccgagaccgccgtcgctcggacgctcctgctcggctgggtcttcgcccaggtggccggcgcttcaggcactacaaatactgtggcagcatataatttaacttggaaatcaactaatttcaagacaattttggagtgggaacccaaacccgtcaatcaagtctacactgttcaaataagcactaagtcaggagattggaaaagcaaatgcttttacacaacagacacagagtgtgacctcaccgacgagattgtgaaggatgtgaagcagacgtacttggcacgggtcttctcctacccggcagggaatgtggagagcaccggttctgctggggagcctctgtatgagaactccccagagttcacaccttacctggagacaaacctcggacagccaacaattcagagttttgaacaggtgggaacaaaagtgaatgtgaccgtagaagatgaacggactttagtcagaaggaacaacactttcctaagcctccgggatgtttttggcaaggacttaatttatacactttattattggaaatcttcaagttcaggaaagaaatattctacatcattggagctgtggtatttgtggtcatcatccttgtcatcatcctggctatatctctacacaagtgtagaaaggcaggagtggggcagagctggaaggagaactccccactgaatgtttcataaa

SEQ ID NO: 123 - DNA, 2153 bp, Homo sapiens
aagactgcgagctccccgcaccccctcgcactccctctggccggcccagggcgccttcagcccaacctccccagccccacgggcgccacggaacccgctcgatctcgccgccaactggtagacatggagacccctgcctggccccgggtcccgcgccccgagaccgccgtcgctcggacgctcctgctcggctgggtcttcgcccaggtggccggcgcttcaggcactacaaatactgtggcagcatataatttaacttggaaatcaactaatttcaagacaattttggagtgggaacccaaacccgtcaatcaagtctacactgttcaaataagcactaagtcaggagattggaaaagcaaatgcttttacacaacagacacagagtgtgacctcaccgacgagattgtgaaggatgtgaagcagacgtacttggcacgggtcttctcctacccggcagggaatgtggagagcaccggttctgctggggagcctctgtatgagaactccccagagttcacaccttacctggagacaaacctcggacagccaacaattcagagttttgaacaggtgggaacaaaagtgaatgtgaccgtagaagatgaacggactttagtcagaaggaacaacactttcctaagcctccgggatgtttttggcaaggacttaatttatacactttattattggaaatcttcaagttcaggaaagaaaacagccaaaacaaacactaatgagtttttgattgatgtggataaaggagaaaactactgtttcagtgttcaagcagtgattccctcccgaacagttaaccggaagagtacagacagcccggtagagtgtatgggccaggagaaaggggaattcagagaaatattctacatcattggagctgtggtatttgtggtcatcatccttgtcatcatcctggctatatctctacacaagtgtagaaaggcaggagtggggcagagctggaaggagaactccccactgaatgtttcataaaggaagcactgttggagctactgcaaatgctatattgcactgtgaccgagaacttttaagaggatagaatacatggaaacgcaaatgagtatttcggagcatgaagaccctggagttcaaaaaactcttgatatgacctgttattaccattagcattctggttttgacatcagcattagtcactttgaaatgtaacgaatggtactacaaccaattccaagttttaatttttaacaccatggcaccttttgcacataacatgctttagattatatattccgcacttaaggattaaccaggtcgtccaagcaaaaacaaatgggaaaatgtcttaaaaaatcctgggtggacttttgaaaagcttttttttttttttttttttgagacggagtcttgctctgttgcccaggctggagtgcagtagcacgatctcggctcacttgcaccctccgtctctcgggttcaagcaattgtctgcctcagcctcccgagtagctgggattacaggtgcgcactaccacgccaagctaatttttgtattttttagtagagatggggtttcaccatcttggccaggctggtcttgaattcctgacctcagtgatccacccaccttggcctcccaaagatgctagtattatgggcgtgaaccaccatgcccagccgaaaagcttttgaggggctgacttcaatccatgtaggaaagtaaaatggaaggaaattgggtgcatttctaggacttttctaacatatgtctataatatagtgtttaggttcttttttttttcaggaatacatttggaaattcaaaacaattgggcaaactttgtattaatgtgttaagtgcaggagacattggtattctgggcagcttcctaatatgctttacaatctgcactttaactgacttaagtggcattaaacatttgagagctaactatatttttataagactactatacaaactacagagtttatgatttaaggtacttaaagcttctatggttgacattgtatatataattttttaaaaaggtttttctatatggggattttctatttatgtaggtaatattgttctatttgtatatattgagataatttatttaatatactttaaataaaggtgactgggaattgtt

SEQ ID NO: 124 - DNA, 1852 bp, Homo sapiens
ttatagcgcgcggggcaccggctccccaagactgcgagctccccgcaccccctcgcactccctctggccggcccagggcgccttcagcccaacctccccagccccacgggcgccacggaacccgctcgatctcgccgccaactggtagacatggagacccctgcctggccccgggtcccgcgccccgagaccgccgtcgctcggacgctcctgctcggctgggtcttcgcccaggtggccggcgcttcaggcactacaaatactgtggcagcatataatttaacttggaaatcaactaatttcaagacaattttggagtgggaacccaaacccgtcaatcaagtctacactgttcaaataagcactaagtcaggagattggaaaagcaaatgcttttacacaacagacacagagtgtgacctcaccgacgagattgtgaaggatgtgaagcagacgtacttggcacgggtcttctcctacccggcagggaatgtggagagcaccggttctgctggggagcctctgtatgagaactccccagagttcacaccttacctggagacaaacctcggacagccaacaattcagagttttgaacaggtgggaacaaaagtgaatgtgaccgtagaagatgaacggactttagtcagaaggaacaacactttcctaagcctccgggatgtttttggcaaggacttaatttatacactttattattggaaatcttcaagttcaggaaagaaaacagccaaaacaaacactaatgagtttttgattgatgtggataaaggagaaaactactgtttcagtgttcaagcagtgattccctcccgaacagttaaccggaagagtacagacagcccggtagagtgtatgggccaggagaaaggggaattcagagaaatattctacatcattggagctgtggtatttgtggtcatcatccttgtcatcatcctggctatatctctacacaagtgtagaaaggcaggagtggggcagagctggaaggagaactccccactgaatgtttcataaaggaagcactgttggagctactgcaaatgctatattgcactgtgaccgagaacttttaagaggatagaatacatggaaacgcaaatgagtatttcggagcatgaagaccctggagttcaaaaaactcttgatatgacctgttattaccattagcattctggttttgacatcagcattagtcactttgaaatgtaacgaatggtactacaaccaattccaagttttaatttttaacaccatggcaccttttgcacataacatgctttagattatatattccgcactcaaggagtaaccaggtcgtccaagcaaaaacaaatgggaaaatgtcttaaaaaatcctgggtggacttttgaaaagctttttttttttttttttttttgagacggagtcttgctctgttgcccaggctggagtgcagtagcacgatctcggctcactgcaccctccgtctctcgggttcaagcaattgtctgcctcagcctcccgagtagctgggattacaggtgcgcactaccacaccaagctaatttttgtattttttagtagagatggggtttcaccatccgaaaagcttttgaggggctgacttcaatccatgtaggaaagtaaaatggaaggaaattgggtgcatttctaggacttttctaacatatgtctataatatagtgtttaggttcttttttttttcaggaatacatttggaaattcaaaacaattggcaaactttgtattaatgtgttaagtgcaggagacattggtattctgggcaccttcctaatatgctttacaatctgcactttaactgactta

SEQ ID NO: 125 - DNA, 2319 bp, Homo sapiens
ttatagcgcgcggggcaccggctccccaagactgcgagctccccgcaccccctcgcactccctctggccggcccagggcgccttcagcccaacctccccagccccacgggcgccacggaacccgctcgatctcgccgccaactggtagacatggagacccctgcctggccccgggtcccgcgccccgagaccgccgtcgctcggacgctcctgctcggctgggtcttcgcccaggtggccggcgcttcaggcactacaaatactgtggcagcatataatttaacttggaaatcaactaatttcaagacaattttggagtgggaacccaaacccgtcaatcaagtctacactgttcaaataagcactaagtcaggagattggaaaagcaaatgcttttacacaacagacacagagtgtgacctcaccgacgagattgtgaaggatgtgaagcagacgtacttggcacgggtcttctcctacccggcagggaatgtggagagcaccggttctgctggggagcctctgtatgagaactccccagagttcacaccttacctggagacaaacctcggacagccaacaattcagagttttgaacaggtgggaacaaaagtgaatgtgaccgtagaagatgaacggactttagtcagaaggaacaacactttcctaagcctccgggatgtttttggcaaggacttaatttatacactttattattggaaatcttcaagttcaggaaagaaaacagccaaaacaaacactaatgagtttttgattgatgtggataaaggagaaaactactgtttcagtgttcaagcagtgattccctcccgaacagttaaccggaagagtacagacagcccggtagagtgtatgggccaggagaaaggggaattcagagaaatattctacatcattggagctgtggtatttgtggtcatcatccttgtcatcatcctggctatatctctacacaagtgtagaaaggcaggagtggggcagagctggaaggagaactccccactgaatgtttcataaaggaagcactgttggagctactgcaaatgctatattgcactgtgaccgagaacttttaagaggatagaatacatggaaacgcaaatgagtatttcggagcatgaagaccctggagttcaaaaaactcttgatatgacctgttattaccattagcattctggttttgacatcagcattagtcactttgaaatgtaacgaatggtactacaaccaattccaagttttaatttttaacaccatggcaccttttgcacataacatgctttagattatatattccgcactcaaggagtaaccaggtcgtccaagcaaaaacaaatgggaaaatgtcttaaaaaatcctgggtggacttttgaaaagctttttttttttttttttttttgagacggagtcttgctctgttgcccaggctggagtgcagtagcacgatctcggctcactgcaccctccgtctctcgggttcaagcaattgtctgcctcagcctcccgagtagctgggattacaggtgcgcactaccacaccaagctaatttttgtattttttagtagagatggggtttcaccatcttggccaggctggtcttgaattcctgacctcaggtgatccacccaccttggcctcccaaagtgctagtattatgggcgtgaaccaccatgcccagccgaaaagcttttgaggggctgacttcaatccatgtaggaaagtaaaatggaaggaaattgggtgcatttctaggacttttctaacatatgtctataatatagtgtttaggttcttttttttttcaggaatacatttggaaattcaaaacaattggcaaactttgtattaatgtgttaagtgcaggagacattggtattctgggcaccttcctaatatgctttacaatctgcactttaactgacttaagtggcattaaacatttgagagctaactatatttttataagactactatacaaactacagagtttatgatttaaggtacttaaagcttctatggttgacattgtatatataattttttaaaaaggttttctatatggggattttctatttatgtaggtaatattgttctatttgtatatattgagataatttatttaatatactttaaataaaggtgactgggaattgttactgttgtacttattctatcttccatttattatttatgtacaatttggtgtttgtattagctctactacagtaaatgactgtaaaattgtcagtggcttacaacaacgtatctttttcgcttataatacattttggtgact

SEQ ID NO: 126 - DNA, 1821 bp, Homo sapiens
ggacgctcctgctcggctgggtcttcgcccaggtggccggcgcttcaggcactacaaatactgtggcagcatataatttaacttggaaatcaactaatttcaagacaattttggagtgggaacccaaacccgtcaatcaagtctacactgttcaaataagcactaagtcaggagattggaaaagcaaatgcttttacacaacagacacagagtgtgacctcaccgacgagattgtgaaggatgtgaagcagacgtacttggcacgggtcttctcctacccggcagggaatgtggagagcaccggttctgctggggagcctctgtatgagaactccccagagttcacaccttacctggagacaaacctcggacagccaacaattcagagttttgaacaggtgggaacaaaagtgaatgtgaccgtagaagatgaacggactttagtcagaaggaacaacactttcctaagcctccgggatgtttttggcaaggacttaatttatacactttattattggaaatcttcaagttcaggaaagaaatattctacatcattggagctgtggtatttgtggtcatcatccttgtcatcatcctggctatatctctacacaagtgtagaaaggcaggagtggggcagagctggaaggagaactccccactgaatgtttcataaaggaagcactgttggagctactgcaaatgctatattgcactgtgaccgagaacttttaagaggatagaatacatggaaacgcaaatgagtatttcggagcatgaagaccctggagttcaaaaaactcttgatatgacctgttattaccattagcattctggttttgacatcagcattagtcactttgaaatgtaacgaatggtactacaaccaattccaagttttaatttttaacaccatggcaccttttgcacataacatgctttagattatatattccgcactcaaggagtaaccaggtcgtccaagcaaaaacaaatgggaaaatgtcttaaaaaatcctgggtggacttttgaaaagctttttttttttttttttttttgagacggagtcttgctctgttgcccaggctggagtgcagtagcacgatctcggctcactgcaccctccgtctctcgggttcaagcaattgtctgcctcagcctcccgagtagctgggattcaggtgcgcactaccacgccaagctaatttttgtattttttagtagagatggggtttcaccatcttggccagcctggtcttgaattctgacctcagtgatccaccacccttggcctcccaaaagtgctagtattatgggcgtgaaccaccatgcccagccgaaaagcttttgaggggctgacttcaatccatgtaggaaagtaaaatggaaggaaattgggtgcatttctaggacttttctaacatatgtctataatatagtgtttaggttcttttttttttcaggaatacatttggaaattcaaaacaattggcaaactttgtattaatgtgttaagtgcaggagacattggtattctgggcaccttcctaatatgctttacaatctgcactttaactgacttaagtggcattaaacatttgagagctaactatatttttataagactactatacaaactacagagtttatgatttaaggtacttaaagcttctatggttgacattgtatatataattttttaaaaaggttttctatatggggattttctatttatgtaggtaatattgttctatttgtatatattgagataatttatttaatatactttaaataaaggtgactgggaattgttactgttg

SEQ ID NO: 127 - protein, 74 aa, Homo sapiens
MWVMLQTLNDEVPKYRDQIPSPGLMVFPKPVTALEYTFSRSDPTSYAGYIEDLKKFLKRWVSTAIGCCSGQLCS

SEQ ID NO: 128 - protein, 232 aa, Homo sapiens [sequence omitted]

SEQ ID NO: 129 - protein, 222 aa, Homo sapiens
MWVMLQTLNDEVPKYRDQIPSPGLMVFPKPVTALEYTFSRSDPTSYAGYIEDLKKFLKPYTLEEQKNLTVCPDGALFEQKGPVYVACQFPISLLQACSGMNDPDFGYSQGNPCILVKMNRIIGLKPEGVPRIDCVSKNEDIPNVAVYPHNGMIDLKYFPYYGKKLHVGYLQPLVAVQVSFAPNNTGKEVTVECKIDGSANLKSQDDRDKFLGRVMFKITARA

SEQ ID NO: 130 - protein, 57 aa, Homo sapiens
NVGYLQPLVAVQVSFAPNNTGKEVTVECKIDGSANLKSQDDRDKFLGRVMFKITARA

SEQ ID NO: 131 - protein, 265 aa, Homo sapiens
MLSEGDILFSSLLSSPSLFWPPGLILLFYLVFYGFLAALFSFTMWVMLQTLNDEVPKYRDQIPSPGLMVFPKPVTALEYTFSRSDPTSYAGYIEDLKKFLKPYTLEEQKNLTVCPDGALFEQKGPVYVACQFPISLLQACSGMNDPDFGYSQGNPCILVKMNRIIGLKPEGVPRIDCVSKNEDIPNVAVYPHNGMIDLKYFPYYGKKLHVGYLQPLVAVQVSFAPNNTGKEVTVECKIDGSANLKSQDDRDKFLGRVMFKITARA

SEQ ID NO: 132 - protein, 279 aa, Homo sapiens
MTKNEKKSLNQSLAEWKLFIYNPTTGEFLGRTAKSWGLILLFYLVFYGFLAALFSFTMWVMLQTLNDEVPKYRDQIPSPGLMVFPKPVTALEYTFSRSDPTSYAGYIEDLKKFLKPYTLEEQKNLTVCPDGALFEQKGPVYVACQFPISLLQACSGMNDPDFGYSQGNPCILVKMNRIIGLKPEGVPRIDCVSKNEDIPNVAVYPHNGMIDLKYFPYYGKKLHVGYLQPLVAVQVSFAPNNTGKEVTVECKIDGSANLKSQDDRDKFLGRVMFKITARA

SEQ ID NO: 133 - protein, 198 aa, Homo sapiens
MVFPKPVTALEYTFSRSDPTSYAGYIEDLKKFLKPYTLEEQKNLTVCPDGALFEQKGPVYVACQFPISLLQACSGMNDPDFGYSQGNPCILVKMNRIIGLKPEGVPRIDCVSKNEDIPNVAVYPHNGMIDLKYFPYYGKKLHVGYLQPLVAVQVSFAPNNTGKEVTVECKIDGSANLKSQDDRDKFLGRVMFKITARA

SEQ ID NO: 134 - protein, 231 aa, Homo sapiens
MLSEGDILFSSLLSSPSLFWPPGLILLFYLVFYGFLAALFSFTMWVMLQTLNDEVPKYRDQIPSPGLMVFPKPVTALEYTFSRSDPTSYAGYIEDLKKFLKPYTLEEQKNLTVCPDGALFEQKGPVYVACQFPISLLQACSGMNDPDFGYSQGNPCILVKMNRIIGLKPEGVPRIDCVSKNEDIPNVAVYPHNGMIDLKYFPYYGKKLHVGYLQPLVAVQVSFAPNNTGKE

SEQ ID NO: 135 - DNA, 1567 bp, Homo sapiens
gaatttctgggggcgcaccgccaagagctggggtttgatcttgctcttctacctagttttttatgggttcctggctgcactcttctcattcacgatgtgggttatgcttcagactctcaacgatgaggttccaaaataccgtgaccagattcctagcccaggactcatggtttttccaaaaccagtgaccgcattggaatatacattcagtaggtctgatccaacttcgtatgcagggtacattgaagaccttaagaagtttctaaaacgttgggtatctacagccattggttgctgttcaggtcagctttgctcctaacaacactgggaaagaagtaacagttgagtgcaagattgatggatcagccaacctaaaaagtcaggatgatcgtgacaagtttttgggacgagttatgttcaaaatcacagcacgtgcatagtatgagtaggatatctccacagagtaaatgttgtgttgtctgtcttcattttgtaacagctggaccttccattctagaattatgagaccaccttggagaaaggtgtgtggtacatgacattgggttacatcataacgtgcttccagatcatagtgttcagtgtcctctgaagtaactgcctgttgcctctgctgccctttgaaccagtgtacagtcgccagatagggaccggtgaacacctgattccaaacatgtaggatgggggtcttgtcctctttttatgtggtttaattgccaagtgtctaaagcttaatatgccgtgctatgtaaatattttatggatataacaactgtcatattttgatgtcaacagagttttagggataaaatggtacccggccaacatcaagtgactttatagctgcaagaaatgtggtatgtggagaagttctgtatgtgaggaaggaaaaaaagaaaataaaagtgtgtttgaaaaatattatcttgggttctttgtaaaatttattttttacatgctgaattagcctcgatctttttgattaagagcacaaacttttttttgtaaaacatgtaaaaaaaaaactgggattaatttttagtgttggaactgcctcttattttaggctgtagataaaatagcatttttaggttagccagtgtgactatgcacctaattttttatgagattaaattcataagacttaatttgtacaatagtttgtgaaatatcttgttactgcttttatttagcagactgtggactgtaataaagtatataaattgtgaaatataaaaacttggaacttattcaaagcttcaaagcaaacaacagttttgtgtaagcattctttcccctccagtattaggtgtattcttggtaggattatttgtgataatttgggctacttggctgagaaagttgtgcttcccatatgatctgtgttgcttcttgttttttcttaaggctattgtttattgttacttttctcctttttaaaaaaaaaaaaaggcagccgggcgcagtggctcacgcctgtagtcccagcactttgggaggccgaggcgggcggatcacaaggtcaagagatcgagaccatcctggccaa

SEQ ID NO: 136 - DNA, 1335 bp, Homo sapiens
acgatgaagaaggagtccctcaaccagagcctcgccgagtggaagctcttcatctacaacccgaccaccggagagttcctgtggcgcaccgccaagagctggggtttgatcttgctcttctacctaattttttatgggttcctggctgcactcttctcattcacgatgtgggttatgcttcagactcaacgatgaggttccaaaataccgtgaccagattcttaacccaggactgatggtttttccaaaaccagtcactgcattggaatatgcattcagtaggtctgatctaacttcgtatgcagggtacactgaagaccttaagaagtttctaaaaccatatactttagaagaacagaaaaacctcacagtctgtcctgatggagcactttttgaacagaagggtccagtttatgttgcttgtcaatctcccgtttcgttacttcaagcatgccgtggtatgaatgatcttgatttcggctattctcaaagaaacccttgtattcttgtgaaaatgaacagaataattggattaaagtctgaaggagtgccagggatagattgtgtttcgaagaatgaagatataccaaatgtagcagtttatcctcataatggaattatagacttaaaatatttcccatattatggggaaaaactgcatgtggggtatctacagccattggttgctgttcaggtcagctttgctcctaacgatactgggaaagaagtaacagttgagtgcaagattgatggatcagccaaccttaaaagtcaggatgatcgtgacaagtttttgggacgagttatgttcaaaatcacagcatgtgcatagtatgagtaggatgtctccacagagtaaattttgtgttgtctgtcttcattttgtatcagctggaccttccattctagaattatgagaccaccttggagaaaggtgtgtggtacatgacactgggttacatcataacgtgcttccagatcatagtgttcaatgtcctctgaagtaactgcctcttgcctctgctgccctttgaaccagtgtacagtcaccagatagggaccggtgaacacctgattccaaacatgtaggatgggggtcttgtcctctttttatgtggtttaattgccaagtgtctaaagcttaatatgctgtgctatgtaaatattttatggctataacactgtcatattttgatgtcaacagagttttagggataaaatggtacccggccaacatcaagtgactttatagctgcaagaaatctggtatgtggagaagttctgcatgtgaggaaggaaaaaaagacaataaaaatgtatttgaaaaatattttt

SEQ ID NO: 137 - DNA, 1858 bp, Homo sapiens
gtttgatcttgctcttctacctagttttttatgggttcctggctgcactcttctcattcacgatgtgggttatgcttcagactctcaacgatgaggttccaaaataccgtgaccagattcctagcccaggactcatggtttttccaaaaccagtgaccgcattggaatatacattcagtaggtctgatccaacttcgtatgcagggtacattgaagaccttaagaagtttctaaaaccatatactttagaagaacagaagaacctcacagtctgtcctgatggagcactttttgaacagaagggtccagtttatgttgcatgtcagtttcctatttcattacttcaagcatgcagtggtatgaatgatcctgattttggctattctcaaggaaacccttgtattcttgtgaaaatgaacagaataattggattaaagcctgaaggagtgccaaggatagattgtgtttcaaagaatgaagatataccaaatgtagcagtttatcctcataatggaatgatagacttaaaatatttcccatattatgggaaaaaactgcatgttgggtatctacagccattggttgctgttcaggtcagctttgctcctaacaacactgggaaagaagtaacagttgagtgcaagattgatggatcagccaacctaaaaagtcaggatgatcgtgacaagtttttgggacgagttatgttcaaaatcacagcacgtgcatagtatgagtaggatatctccacagagtaaatgttgtgttgtctgtcttcattttgtaacagctggaccttccattctagaattatgagaccaccttggagaaaggtgtgtggtacatgacattgggttacatcataacgtgcttccagatcatagtgttcagtgtcctctgaagtaactgcctgttgcctctgctgccctttgaaccagtgtacagtcgccagatagggaccggtgaacacctgattccaaacatgtaggatgggggtcttgtcctctttttatgtggtttaattgccaagtgtctaaagcttaatatgccgtgctatgtaaatattttatggatataacaactgtcatattttgatgtcaacagagttttagggataaaatggtacccggccaacatcaagtgactttatagctgcaagaaatgtggtatgtggagaagttctgtatgtgaggaaggaaaaaaagaaaataaaagtgtgtttgaaaaatattatcttgggttctttgtaaaatttattttttacatgctgaattagcctcgatctttttgattaagagcacaaacttttttttgtaaaacatgtaaaaaaaaaactgggattaatttttagtgttggaactgcctcttattttaggctgtagataaaatagcatttttaggttagccagtgtgactatgcacctaattttttatgagattaaattcataagacttaatttgtacaatagtttgtgaaatatcttgttactgcttttatttagcagactgtggactgtaataaagtatataaattgtgaaatataaaaacttggaacttattcaaagcttcaaagcaaacaacagttttgtgtaagcattctttcccctccagtattaggtgtattcttggtaggattatttgtgataatttgggctacttggctgagaaagttgtgcttcccatatgatctgtgttgcttcttgttttttcttaaggctattgtttattgttacttttctcctttttaaaaaaaaaaaaaggcagccgggcgcagtggctcacgcctgtagtcccagcactttgggaggccgaggcgggcggatcacaaggtcaagagatcgagaccatcctggccaa

SEQ ID NO: 138 - DNA, 1546 bp, Homo sapiens
gaatttctgggggcgcaccgccaagagctggggtttgatcttgctcttctacctagttttttatgggttcctggctgcactcttctcattcacgatgtgggttatgcttcagactctcaacgatgaggttccaaaataccgtgaccagattcctagcccaggactcatggtttttccaaaaccagtgaccgcattggaatatacattcagtaggtctgatccaacttcgtatgcagggtacattgaagaccttaagaagtttctaaaaccatatactttagaagaacagaagaacctcacagtctgtcctgatggagcactttttgaacagaagggtccagtttatgttgcatgtcagtttcctatttcattacttcaagcatgcagtggtatgaatgatcctgattttggctattctcaaggaaacccttgtattcttgtgaaaatgaacagaataattggattaaagcctgaaggagtgccaaggatagattgtgtttcaaagaatgaagatataccaaatgtagcagtttatcctcataatggaatgatagacttaaaatatttcccatattatgggaaaaaactgcatgttgggtatctacagccattggttgctgttcaggtcagctttgctcctaacaacactgggaaagaagtaacagttgagtgcaagattgatggatcagccaacctaaaaagtcaggatgatcgtgacaagtttttgggacgagttatgttcaaaatcacagcacgtgcatagtatgagtaggatatctccacagagtaaatagttttagggataaaatggtacccggccaacatcaagtgactttatagctgcaagaaatgtggtatgtggagaagttctgtatgtgaggaaggaaaaaaagaaaataaaagtgtgtttgaaaaatattatcttgggttctttgtaaaatttattttttacatgctgaattagcctcgatctttttgattaagagcacaaacttttttttgtaaaacatgtaaaaaaaaaactgggattaatttttagtgttggaactgcctcttattttaggctgtagataaaatagcatttttaggttagccagtgtgactatgcacctaattttttatgagattaaattcataagacttaatttgtacaatagtttgtgaaatatcttgttactgcttttatttagcagactgtggactgtaataaagtatataaattgtgaaatataaaaacttggaacttattcaaagcttcaaagcaaacaacagttttgtgtaagcattctttcccctccagtattaggtgtattcttggtaggattatttgtgataatttgggctacttggctgagaaagttgtgcttcccatatgatctgtgttgcttcttgttttttcttaaggctattgtttattgttacttttctcctttttaaaaaaaaaaaaaggcagccgggcgcagtggctcacgcctgtagtcccagcactttgggaggccgaggcgggcggatcacaaggtcaagagatcgagaccatcctggccaa

SEQ ID NO: 139 - DNA, 1567 bp, Homo sapiens; identical to SEQ ID NO: 135

SEQ ID NO: 140 - DNA, 1982 bp, Homo sapiens
gaatttctgggggcgcaccgccaagagctggggatcgcagtatgtggtagggaagtgatgctgtctgaaggtgacatcctgttctcctctcttctgtcctctccatccttattttggccacctggtttgatcttgctcttctacctagttttttatgggttcctggctgcactcttctcattcacgatgtgggttatgcttcagactctcaacgatgaggttccaaaataccgtgaccagattcctagcccaggactcatggtttttccaaaaccagtgaccgcattggaatatacattcagtaggtctgatccaacttcgtatgcagggtacattgaagaccttaagaagtttctaaaaccatatactttagaagaacagaagaacctcacagtctgtcctgatggagcactttttgaacagaagggtccagtttatgttgcatgtcagtttcctatttcattacttcaagcatgcagtggtatgaatgatcctgattttggctattctcaaggaaacccttgtattcttgtgaaaatgaacagaataattggattaaagcctgaaggagtgccaaggatagattgtgtttcaaagaatgaagatataccaaatgtagcagtttatcctcataatggaatgatagacttaaaatatttcccatattatgggaaaaaactgcatgttgggtatctacagccattggttgctgttcaggtcagctttgctcctaacaacactgggaaagaagtaacagttgagtgcaagattgatggatcagccaacctaaaaagtcaggatgatcgtgacaagtttttgggacgagttatgttcaaaatcacagcacgtgcatagtatgagtaggatatctccacagagtaaatgttgtgttgtctgtcttcattttgtaacagctggaccttccattctagaattatgagaccaccttggagaaaggtgtgtggtacatgacattgggttacatcataacgtgcttccagatcatagtgttcagtgtcctctgaagtaactgcctgttgcctctgctgccctttgaaccagtgtacagtcgccagatagggaccggtgaacacctgattccaaacatgtaggatgggggtcttgtcctctttttatgtggtttaattgccaagtgtctaaagcttaatatgccgtgctatgtaaatattttatggatataacaactgtcatattttgatgtcaacagagttttagggataaaatggtacccggccaacatcaagtgactttatagctgcaagaaatgtggtatgtggagaagttctgtatgtgaggaaggaaaaaaagaaaataaaagtgtgtttgaaaaatattatcttgggttctttgtaaaatttattttttacatgctgaattagcctcgatctttttgattaagagcacaaacttttttttgtaaaacatgtaaaaaaaaaactgggattaatttttagtgttggaactgcctcttattttaggctgtagataaaatagcatttttaggttagccagtgtgactatgcacctaattttttatgagattaaattcataagacttaatttgtacaatagtttgtgaaatatcttgttactgcttttatttagcagactgtggactgtaataaagtatataaattgtgaaatataaaaacttggaacttattcaaagcttcaaagcaaacaacagttttgtgtaagcattctttcccctccagtattaggtgtattcttggtaggattatttgtgataatttgggctacttggctgagaaagttgtgcttcccatatgatctgtgttgcttcttgttttttcttaaggctattgtttattgttacttttctcctttttaaaaaaaaaaaaaggcagccgggcgcagtggctcacgcctgtagtcccagcactttgggaggccgaggcgggcggatcacaaggtcaagagatcgagaccatcctggccaa

SEQ ID NO: 141 - DNA, 1266 bp, Homo sapiens
  misc_feature (1)...(1266): n = A,T,C or G
gaattcccattgacccgaggctcccggttgaacccttcaagggagccaagcgaggacgttctcagaacagcagtgcaccgtgtacattgtgggagccccgcgcgatcccccgcagagcgtcctgtaggaacgtcacagagcccagagagcgtcctgtaggaacgtcacagagcccagagagcgtcctgtaggaacgtcacagagcccagagagcgtcctgtaggaacgtcacagagcccagagaacgcctggggacggtcggggaggcagttcggggaggggacgattaagttccctcagagaggaagccgcgggccgactggagtcgttttcgtgctctccgcacccgcccgccgcgggtagcatcttctcagcgccccggcgcccaggaacgcccaggaaacccagtcctcctcctaagcaacctgcggcgcggggacgcccgccttttgctattattataaacgtgcgtgcgactaaaccttcggatttttagactttcttctcgcttcctctgacccaggctgagggagcccccgaggctactgcggggcggggccggggcggggtggggcgccctcgccgcctcaggcagcgccccggccgctggcgggaggcggcagcggcgcgggccgagcggcgcggggattggctgcggcgggcggagacgtcaggctcccgcggcccaagcggccgcccggcgcgncgcggcgcagtcggctcgagtactccccgtaacgaggaggtgttctcggccgtcccacccttcactgccgtctccgggctgcgccgccggagccgggacgcgcctccgcagccctcgccgcctccatccccgcggccgcagctcctctcgccgtccgcgcgcacaccatgacgaagaacgagaagaagtccctcaaccagagcctggccgagtggaagctcttcatctacaacccgaccaccggagaattcctggggcgcaccgccaagagctggggtgagcgggcagcagctgggcgtccggggccggcctcggtcccgggggcgccgggcgcggtctggtgggaacggaaaggcgggaggcggctcccagcgccggggctcccgaccgcccgaccctaacccgggcggcggcggcgcagtgcggccccattcattgctccccgggccggccggactggccgcagctcgctcccgaagcagcggggcccgcgggcagcccggccgggccgcgctggttcctccctccctgctgggagcggggcgcacgtgctgcccggg

SEQ ID NO: 142 - DNA, 1858 bp, Homo sapiens; identical to SEQ ID NO: 137

SEQ ID NO: 143 - DNA, 2143 bp, Homo sapiens
ggggaggggacgattaagttccctcagagaggaagccgcgggccgactggagtcgttttcgtgctctccgcacccgcccgccgcgggtagcatcttctcagcgccccggcgcccaggaacgcccaggaaacccagtcctcctcctaagcaacctgcggcgcggggacgcccgccttttgctattattataaacgatcgcagtatgtggtagggaagtgatgctgtctgaaggtgacatcctgttctcctctcttctgtcctctccatccttattttggccacctggtttgatcttgctcttctacctagttttttatgggttcctggctgcactcttctcattcacgatgtgggttatgcttcagactctcaacgatgaggttccaaaataccgtgaccagattcctagcccaggactcatggtttttccaaaaccagtgaccgcattggaatatacattcagtaggtctgatccaacttcgtatgcagggtacattgaagaccttaagaagtttctaaaaccatatactttagaagaacagaagaacctcacagtctgtcctgatggagcactttttgaacagaagggtccagtttatgttgcatgtcagtttcctatttcattacttcaagcatgcagtggtatgaatgatcctgattttggctattctcaaggaaacccttgtattcttgtgaaaatgaacagaataattggattaaagcctgaaggagtgccaaggatagattgtgtttcaaagaatgaagatataccaaatgtagcagtttatcctcataatggaatgatagacttaaaatatttcccatattatgggaaaaaactgcatgttgggtatctacagccattggttgctgttcaggtcagctttgctcctaacaacactgggaaagaagtaacagttgagtgcaagattgatggatcagccaacctaaaaagtcaggatgatcgtgacaagtttttgggacgagttatgttcaaaatcacagcacgtgcatagtatgagtaggatatctccacagagtaaatgttgtgttgtctgtcttcattttgtaacagctggaccttccattctagaattatgagaccaccttggagaaaggtgtgtggtacatgacattgggttacatcataacgtgcttccagatcatagtgttcagtgtcctctgaagtaactgcctgttgcctctgctgccctttgaaccagtgtacagtcgccagatagggaccggtgaacacctgattccaaacatgtaggatgggggtcttgtcctctttttatgtggtttaattgccaagtgtctaaagcttaatatgccgtgctatgtaaatattttatggatataacaactgtcatattttgatgtcaacagagttttagggataaaatggtacccggccaacatcaagtgactttatagctgcaagaaatgtggtatgtggagaagttctgtatgtgaggaaggaaaaaaagaaaataaaagtgtgtttgaaaaatattatcttgggttctttgtaaaatttattttttacatgctgaattagcctcgatctttttgattaagagcacaaacttttttttgtaaaacatgtaaaaaaaaaactgggattaatttttagtgttggaactgcctcttattttaggctgtagataaaatagcatttttaggttagccagtgtgactatgcacctaattttttatgagattaaattcataagacttaatttgtacaatagtttgtgaaatatcttgttactgcttttatttagcagactgtggactgtaataaagtatataaattgtgaaatataaaaacttggaacttattcaaagcttcaaagcaaacaacagttttgtgtaagcattctttcccctccagtattaggtgtattcttggtaggattatttgtgataatttgggctacttggctgagaaagttgtgcttcccatatgatctgtgttgcttcttgttttttcttaaggctattgtttattgttacttttctcctttttaaaaaaaaaaaaaggcagccgggcgcagtggctcacgcctgtagtcccagcactttgggaggccgaggcgggcggatcacaaggtcaagagatcgagaccatcctggccaa

SEQ ID NO: 144 - protein, 457 aa, Homo sapiens
MRPPSPLPARWLCVLAGALAWALGPAGGQAARLQEECDYVQMIEVQHKQCLEEAQLENETIGCSKMWDNLTCWPATPRGQVVVLACPLIFKLFSSIQGRNVSRSCTDEGWTHLEPGPYPIACGLDDKAASLDEQQTMFYGSVKTGYTIGYGLSLATLLVATAILSLFRKLHCTRNYIHMHLFISFILRAAAVFIKDLALFDSGESDQCSEGSVGCKAAMVFFQYCVMANFFWLLVEGLYLYTLLAVSFFSERKYFWGYILIGWGVPSTFTMVWTIARIHFEDYGCWDTINSSLWWIIKGPILTSILVNFILFICIIRILLQKLRPPDIRKSDSSPYSRLARSTLLLIPLFGVHYIMFAFFPDNFKPEVKMVFELVVGSFQGFVVAILYCFLNGEVQAELRRKWRRWHLQGVLGWNPKYRHPSGGSNGATCSTQVSMLTRVSPGARRSSSFQAEVSLV

SEQ ID NO: 145 - protein, 416 aa, Homo sapiens
MIEVQHKQCLEEAQLENETIGCSKMWDNLTCWPATPRGQVVVLACPLIFKLFSSIQGRNVSRSCTDEGWTHLEPGPYPIACGLDDKAASLDEQQTMFYGSVKTGYTIGYGLSLATLLVATAILSLFRKLHCTRNYIHMHLFISFILRAAAVFIKDLALFDSGESDQCSEGSVGCKAAMVFFQYCVMANFFWLLVEGLYLYTLLAVSFFSERKYFWGYILIGWGVPSTFTMVWTIARIHFEDYGCWDTINSSLWWIIKGPILTSILVNFILFICIIRILLQKLRPPDIRKSDSSPYSRLARSTLLLIPLFGVHYIMFAFFPDNFKPEVKMVFELVVGSFQGFVVAILYCFLNGEVQAELRRKWRRWHLQGVLGWNPKYRHPSGGSNGATCSTQVSMLTRVSPGARRSSSFQAEVSLV

SEQ ID NO: 146 - DNA, 2807 bp, Homo sapiens
cgcccccagccctgagctgcgcctcttagctctggggccacagcgccagcgccactctgccaggctcccggccatcgcccgcctggtgcgccgcccgccagctctttgcccgcgcggggccgcccgccgcgggctcagggcagaccatgcgcccgccaagtccgctgcccgcccgctggctatgcgtgctggcaggcgccctcgcctgggcccttgggccggcgggcggccaggcggccaggctgcaggaggagtgtgactatgtgcagatgatcgaggtgcagcacaagcagtgcctggaggaggcccagctggagaatgagacaataggctgcagcaagatgtgggacaacctcacctgctggccagccacccctcggggccaggtagttgtcttggcctgtcccctcatcttcaagctcttctcctccattcaaggccgcaatgtaagccgcagctgcaccgacgaaggctggacgcacctggagcctggcccgtaccccattgcctgtggtttggatgacaaggcagcgagtttggatgagcagcagaccatgttctacggttctgtgaagaccggctacaccattggctacggcctgtccctcgccacccttctggtcgccacagctatcctgagcctgttcaggaagctccactgcacgcggaactacatccacatgcacctcttcatatccttcatcctgagggctgccgctgtcttcatcaaagacttggccctcttcgacagcggggagtcggaccagtgctccgagggctcggtgggctgtaaggcagccatggtctttttccaatattgtgtcatggctaacttcttctggctgctggtggagggcctctacctgtacaccctgcttgccgtctccttcttctctgagcggaagtacttctgggggtacatactcatcggctggggggtacccagcacattcaccatggtgtggaccatcgccaggatccattttgaggattatgggtgctgggacaccatcaactcctcactgtggtggatcataaagggccccatcctcacctccatcttggtaaacttcatcctgtttatttgcatcatccgaatcctgcttcagaaactgcggcccccagatatcaggaagagtgacagcagtccatactcaaggctagccaggtccacactcctgctgatccccctgtttggagtacactacatcatgttcgccttctttccggacaattttaagcctgaagtgaagatggtctttgagctcgtcgtggggtctttccagggttttgtggtggctatcctctactgcttcctcaatggtgaggtgcaggcggagctgaggcggaagtggcggcgctggcacctgcagggcgtcctgggctggaaccccaaataccggcacccgtcgggaggcagcaacggcgccacgtgcagcacgcaggtttccatgctgacccgcgtcagcccaggtgcccgccgctcctccagcttccaagccgaagtctccctggtctgaccaccaggatcccaggggcccaaggcggcccctcccgccccttcccactcaccccggcagacgccggggacagaggcctgcccgggcgcggccagccccggccctgggctcggaggctgcccccggccccctggtctctggtccggacactcctagagaacgcagccctagagcctgcctggagcgtttctagcaagtgagagagatgggagctcctctcctggaggattgcaggtggaactcagtcattagactcctcctccaaaggccccctacgccaatcaagggcaaaaagtctacatactttcatcctgactctgccccctgctggctcttctgcccaattggaggaaagcaaccggtggatcctcaaacaacactggtgtgacctgagggcagaaaggttctgcccgggaaggtcaccagcaccaacaccacggtagtgcctgaaatttcaccattgctgtcaagttcctttgggttaagcattaccactcaggcatttgactgaagatgcagctcactaccccattctctctttacgcttagctatcagcttttcaaagtgggttattctggagtttttgtttggagagcacacctatcttagtggttccccaccgaagtggactggcccctgggtcagtctggtgggaggacggtgcaacccaaggactgagggactctgaagcctctgggaaatgagaaggcagccaccagcgaatgctaggtctcggactaagcctacctgctctccaagtctcagtggcttcatctgtcaagtgggatctgtcacaccagccatacttatctctctgtgctgtggaagcaacaggaatcaagagctgccctccttgtccacccacctatgtgccaactgttgtaactaggctcagagatgtgcacccatgggctctgacagaaagcagatacctcaccctgctacacatacaggatttgaactcagatctgtctgataggaatgtgaaagcacggactcttactgctaacttttgtgtatcgtaaccagccagatcctcttggttatttgtttaccacttgtattattaatgccattatccctgaatcccccttgccaccccaccctccctggagtgtggctgaggaggcctccatctcatgtatcatctggataggagcctgctggtcacagcctcctctgtctgcccttcaccccagtggccactcagcttcctacccacacctctgccagaagatcccctcaggactgcaacaggcttgtgcaacaataaatgttggcttgga

SEQ ID NO: 147 - DNA, 2768 bp, Homo sapiens
aagagtaaaggagctgtggcttccccccaatcagaagggcactggatgatggatgaactctgtgtggtgcgtcttcacactgacaccaggaggataaggaagtgactccctcagctgagtggctggcatgtgccaggctagagcagcttggctatggcagaacatccagccccaccgtgtggacgggcggccaggcggccaggctgcaggaggagtgtgactatgtgcagatgatcgaggtgcagcacaagcagtgcctggaggaggcccagctggagaatgagacaataggctgcagcaagatgtgggacaacctcacctgctggccagccacccctcggggccaggtagttgtcttggcctgtcccctcatcttcaagctcttctcctccattcaaggccgcaatgtaagccgcagctgcaccgacgaaggctggacgcacctggagcctggcccgtaccccattgcctgtggtttggatgacaaggcagcgagtttggatgagcagcagaccatgttctacggttctgtgaagaccggctacaccattggctacggcctgtccctcgccacccttctggtcgccacagctatcctgagcctgttcaggaagctccactgcacgcggaactacatccacatgcacctcttcatatccttcatcctgagggctgccgctgtcttcatcaaagacttggccctcttcgacagcggggagtcggaccagtgctccgagggctcggtgggctgtaaggcagccatggtctttttccaatattgtgtcatggctaacttcttctggctgctggtggagggcctctacctgtacaccctgcttgccgtctccttcttctctgagcggaagtacttctgggggtacatactcatcggctggggggtacccagcacattcaccatggtgtggaccatcgccaggatccattttgaggattatgggtgctgggacaccatcaactcctcactgtggtggatcataaagggccccatcctcacctccatcttggtaaacttcatcctgtttatttgcatcatccgaatcctgcttcagaaactgcggcccccagatatcaggaagagtgacagcagtccatactcaaggctagccaggtccacactcctgctgatccccctgtttggagtacactacatcatgttcgccttctttccggacaattttaagcctgaagtgaagatggtctttgagctcgtcgtggggtctttccagggttttgtggtggctatcctctactgcttcctcaatggtgaggtgcaggcggagctgaggcggaagtggcggcgctggcacctgcagggcgtcctgggctggaaccccaaataccggcacccgtcgggaggcagcaacggcgccacgtgcagcacgcaggtttccatgctgacccgcgtcagcccaggtgcccgccgctcctccagcttccaagccgaagtctccctggtctgaccaccaggatcccaggggcccaaggcggcccctcccgccccttcccactcaccccggcagacgccggggacagaggcctgcccgggcgcggccagccccggccctgggctcggaggctgcccccggccccctggtctctggtccggacactcctagagaacgcagccctagagcctgcctggagcgtttctagcaagtgagagagatgggagctcctctcctggaggattgcaggtggaactcagtcattagactcctcctccaaaggccccctacgccaatcaagggcaaaaagtctacatactttcatcctgactctgccccctgctggctcttctgcccaattggaggaaagcaaccggtggatcctcaaacaacactggtgtgacctgagggcagaaaggttctgcccgggaaggtcaccagcaccaacaccacggtagtgcctgaaatttcaccattgctgtcaagttcctttgggttaagcattaccactcaggcatttgactgaagatgcagctcactaccccattctctctttacgcttagctatcagcttttcaaagtgggttattctggagtttttgtttggagagcacacctatcttagtggttccccaccgaagtggactggcccctgggtcagtctggtgggaggacggtgcaacccaaggactgagggactctgaagcctctgggaaatgagaaggcagccaccagcgaatgctaggtctcggactaagcctacctgctctccaagtctcagtggcttcatctgtcaagtgggatctgtcacaccagccatacttatctctctgtgctgtggaagcaacaggaatcaagagctgccctccttgtccacccacctatgtgccaactgttgtaactaggctcagagatgtgcacccatgggctctgacagaaagcagatacctcaccctgctacacatacaggatttgaactcagatctgtctgataggaatgtgaaagcacggactcttactgctaacttttgtgtatcgtaaccagccagatcctcttggttatttgtttaccacttgtattattaatgccattatccctgaatcccccttgccaccccaccctccctggagtgtggctgaggaggcctccatctcatgtatcatctggataggagcctgctggtcacagcctcctctgtctgcccttcaccccagtggccactcagcttcctacccacacctctgccagaagatcccctcaggactgcaacaggcttgtgcaacaataaatgttggcttgga

SEQ ID NO: 148 - protein, 766 aa, Homo sapiens
MKTPWKVLLGLLGAAALVTIITVPVVLLNKGTDDATADSRKTYTLTDYLKNTYRLKLYSLRWISDHEYLYKQENNILVFNAEYGNSSVFLENSTFDEFGHSINDYSISPDGQFILLEYNYVKQWRHSYTASYDIYDLNKRQLITEERIPNNTQWVTWSPVGHKLAYVWNNDIYVKIEPNLPSYRITWTGKEDIIYNGITDWVYEEEVFSAYSALWWSPNGTFLAYAQFNDTEVPLIEYSFYSDESLQYPKTVRVPYPKAGAVNPTVKFFVVNTDSLSSVTNATSIQITAPASMLIGDHYLCDVTWATQERISLQWLRRIQNYSVMDICDYDESSGRWNCLVARQHIEMSTTGWVGRFRPSEPHFTLDGNSFYKIISNEEGYRHICYFQIDKKDCTFITKGTWEVIGIEALTSDYLYYISNEYKGMPGGRNLYKIQLSDYTKVTCLSCELNPERCQYYSVSFSKEAKYYQLRCSGPGLPLYTLHSSVNDKGLRVLEDNSALDKMLQNVQMPSKKLDFIILNETKFWYQMILPPHFDKSKKYPLLLDVYAGPCSQKADTVFRLNWATYLASTENIIVASFDGRGSGYQGDKIMHAINRRLGTFEVEDQIEAARQFSKMGFVDNKRIAIWGWSYGGYVTSMVLGSGSGVFKCGIAVAPVSRWEYYDSVYTERYMGLPTPEDNLDHYRNSTVMSRAENFKQVEYLLIHGTADDNVHFQQSAQISKALVDVGVDFQAMWYTDEDHGIASSTAHQHIYTHMSHFIKQCFSLP

SEQ ID NO: 149 - protein, 474 aa, Homo sapiens
MLIGDHYLCDVTWATQERISLQWLRRIQNYSVMDICDYDESSGRWNCLVARQHIEMSTTGWVGRFRPSEPHFTLDGNSFYKIISNEEGYRHICYFQIDKKDCTFITKGTWEVIGIEALTSDYLYYISNEYKGMPGGRNLYKIQLSDYTKVTCLSCELNPERCQYYSVSFSKEAKYYQLRCSGPGLPLYTLHSSVNDKGLRVLEDNSALDKMLQNVQMPSKKLDFIILNETKFWYQMILPPHFDKSKKYPLLLDVYAGPCSQKADTVFRLNWATYLASTENIIVASFDGRGSGYQGDKIMHAINRRLGTFEVEDQIEAARQFSKMGFVDNKRIAIWGWSYGGYVTSMVLGSGSGVFKCGIAVAPVSRWEYYDSVYTERYMGLPTPEDNLDHYRNSTVMSRAENFKQVEYLLIHGTADDNVHFQQSAQISKALVDVGVDFQAMWYTDEDHGIASSTAHQHIYTHMSHFIKQCFSLP

SEQ ID NO: 150 - DNA, 3453 bp, Homo sapiens
gagtgactccaccgcccggagcagcggtgcaggacgcgcgtctccgccgcccgcggtgacttctgcctgcgctccttctctgaacgctcacttccgaggagacgccgacgatgaagacaccgtggaaggttcttctgggactgctgggtgctgctgcgcttgtcaccatcatcaccgtgcccgtggttctgctgaacaaaggcacagatgatgctacagctgacagtcgcaaaacttacactctaactgattacttaaaaaatacttatagactgaagttatactccttaagatggatttcagatcatgaatatctctacaaacaagaaaataatatcttggtattcaatgctgaatatggaaacagctcagttttcttggagaacagtacatttgatgagtttggacattctatcaatgattattcaatatctcctgatgggcagtttattctcttagaatacaactacgtgaagcaatggaggcattcctacacagcttcatatgacatttatgatttaaataaaaggcagctgattacagaagagaggattccaaacaacacacagtgggtcacatggtcaccagtgggtcataaattggcatatgtttggaacaatgacatttatgttaaaattgaaccaaatttaccaagttacagaatcacatggacggggaaagaagatataatatataatggaataactgactgggtttatgaagaggaagtcttcagtgcctactctgctctgtggtggtctccaaacggcacttttttagcatatgcccaatttaacgacacagaagtcccacttattgaatactccttctactctgatgagtcactgcagtacccaaagactgtacgggttccatatccaaaggcaggagctgtgaatccaactgtaaagttctttgttgtaaatacagactctctcagctcagtcaccaatgcaacttccatacaaatcactgctcctgcttctatgttgataggggatcactacttgtgtgatgtgacatgggcaacacaagaaagaatttctttgcagtggctcaggaggattcagaactattcggtcatggatatttgtgactatgatgaatccagtggaagatggaactgcttagtggcacggcaacacattgaaatgagtactactggctgggttggaagatttaggccttcagaacctcattttacccttgatggtaatagcttctacaagatcatcagcaatgaagaaggttacagacacatttgctatttccaaatagataaaaaagactgcacatttattacaaaaggcacctgggaagtcatcgggatagaagctctaaccagtgattatctatactacattagtaatgaatataaaggaatgccaggaggaaggaatctttataaaatccaacttagtgactatacaaaagtgacatgcctcagttgtgagctgaatccggaaaggtgtcagtactattctgtgtcattcagtaaagaggcgaagtattatcagctgagatgttccggtcctggtctgcccctctatactctacacagcagcgtgaatgataaagggctgagagtcctggaagacaattcagctttggataaaatgctgcagaatgtccagatgccctccaaaaaactggacttcattattttgaatgaaacaaaattttggtatcagatgatcttgcctcctcattttgataaatccaagaaatatcctctactattagatgtgtatgcaggcccatgtagtcaaaaagcagacactgtcttcagactgaactgggccacttaccttgcaagcacagaaaacattatagtagctagctttgatggcagaggaagtggttaccaaggagataagatcatgcatgcaatcaacagaagactgggaacatttgaagttgaagatcaaattgaagcagccagacaattttcaaaaatgggatttgtggacaacaaacgaattgcaatttggggctggtcatatggagggtacgtaacctcaatggtcctgggatcgggaagtggcgtgttcaagtgtggaatagccgtggcgcctgtatcccggtgggagtactatgactcagtgtacacagaacgttacatgggtctcccaactccagaagacaaccttgaccattacagaaattcaacagtcatgagcagagctgaaaattttaaacaagttgagtacctccttattcatggaacagcagatgataacgttcactttcagcagtcagctcagatctccaaagccctggtcgatgttggagtggatttccaggcaatgtggtatactgatgaagaccatggaatagctagcagcacagcacaccaacatatatatacccacatgagccacttcataaaacaatgtttctctttaccttagcacctcaaaataccatgccatttaaagcttattaaaactcatttttgttttcattatctcaaaactgcactgtcaagatgatgatgatctttaaaatacacactcaaatcaagaaacttaaggttacctttgttcccaaatttcatacctatcatcttaagtagggacttctgtcttcacaacagattattaccttacagaagtttgaattatccggtcgggttttattgtttaaaatcatttctgcatcagctgctgaaacaacaaataggaattgtttttatggaggctttgcatagattccctgagcaggattttaatctttttctaactggactggttcaaatgttgttctcttctttaaagggatggcaagatgtgggcagtgatgtcactagggcagggacaggataagagggattagggagagaagatagcagggcatggctgggaacccaagtccaagcataccaacacgagcaggctactgtcagctcccctcggagaagagctgttcacagccagactggcacagttttctgagaaagactattcaaacagtctcaggaaatcaaatatgcaaagcactgacttctaagtaaaaccacagcagttgaaaagactccaaagaaatgtaagggaaactgccagcaacgcaggcccccaggtgccagttatggctataggtgctacaaaaacacagcaagggtgatgggaaagcattgtaaatgtgcttttaaaaaaaaatactgatgttcctagtgaaagaggcagcttgaaactgagatgtgaacacatcagcttgccctgttaaaagatgaaaatatttgtatcacaaatcttaacttgaaggagtccttgcatcaatttttcttatttcatttctttgagtgtcttaattaaaagaatattttaacttccttggactcattttaaaaaatggaacataaaatacaatgttatgtattattattcccattctacatactatggaatttctcccagtcatttaataaatgtgccttcattttttcagaagtaa

SEQ ID NO: 151 - DNA, 3453 bp, Homo sapiens; identical to SEQ ID NO: 150

SEQ ID NO: 152 - protein, 252 aa, Homo sapiens
MALLLCFVLLCGVVDFARSLSITTPEEMIEKAKGETAYLPCKFTLSPEDQGPLDIEWLISPADNQKVDQVIILYSGDKIYDDYYPDLKGRVHFTSNDLKSGDASINVTNLQLSDIGTYQCKVKKAPGVANKKIHLVVLVKPSGARCYVDGSEEIGSDFKIKCEPKEGSLPLQYEWQKLSDSQKMPTSWLAGKMCHLQRAVRPLPEATSAVIIHPWGPCLLPTWKDIPRLSITKYQVKTLNALLRVRLSHLLR

SEQ ID NO: 153 - protein, 365 aa, Homo sapiens
MALLLCFVLLCGVVDFARSLSITTPEEMIEKAKGETAYLPCKFTLSPEDQGPLDIEWLISPADNQKVDQVIILYSGDKIYDDYYPDLKGRVHFTSNDLKSGDASINVTNLQLSDIGTYQCKVKKAPGVANKKIHLVVLVKPSGARCYVDGSEEIGSDFKIKCEPKEGSLPLQYEWQKLSDSQKMPTSWLAEMTSSVISVKNASSEYSGTYSCTVRNRVGSDQCLLRLNVVPPSNKAGLIAGAIIGTLLALALIGLIIFCCRKKRREEKYEKEVHHDIREDVPPPKSRTSTARSYIGSNHSSLGSMSPSNMEGYSKTQYNQVPSEDFERTPQSPTLPPAKVAAPNLSRMGAIPVMIPAQSKDGSIV

SEQ ID NO: 154 - protein, 200 aa, Homo sapiens
MALLLCFVLLCGVVDFARSLSITTPEEMIEKAKGETAYLPCKFTLSPEDQGPLDIEWLISPADNQKVDQVIILYSGDKIYDDYYPDLKGRVHFTSNDLKSGDASINVTNLQLSDIGTYQCKVKKAPGVANKKIHLVVLGKMCHLQRAVRPLPEATSAVIIHPWGPCLLPTWKDIPRLSITKYQVKTLNALLRVRLSHLLR

SEQ ID NO: 155 - protein, 179 aa, Homo sapiens
MQIMLSPEDQGPLDIEWLISPADNQKMDQVMILYSGNKIYDDYYPELKGRVHFKRNDLKSGDASINVTNLQLSDIGTDQCKVKKAPGVANKIQLVVLVKPSGTRCYVDGSEEIGSDFKLKCEPKEGSLPLQYEWQKLSDSQKMPTSWLAEMTSSVISVKKMLLLSTLGHTAVHQKRSGL

SEQ ID NO: 156 - protein, 89 aa, Homo sapiens
MALLLCFVLLCGVVDFARSLSITTPEEMIEKAKGETAYLPCKFTLSPEDQGPLDIEWLISPADNQKVDQVGRCATSKEPYVHCQKLHRQ

SEQ ID NO: 157 - protein, 344 aa, Homo sapiens
MALLLCFVLLCGVVDFARSLSITTPEEMIEKAKGETAYLPCKFTLSPEDQGPLDIEWLISPADNQKVDQVIILYSGDKIYDDYYPDLKGRVHFTSNDLKSGDASINVTNLQLSDIGTYQCKVKKAPGVANKKIHLVVLVKPSGARCYVDGSEEIGSDFKIKCEPKEGSLPLQYEWQKLSDSQKMPTSWLAEMTSSVISVKNASSEYSGTYSCTVRNRVGSDQCLLRLNVVPPSNKAGLIAGAIIGTLLALALIGLIIFCCRKKRREEKYEKEVHHDIREDVPPPKSRTSTARSYIGSNHSSLGSMSPSNMEGYSKTQYNQVPSEDFERTPQSPTLPPAKFKYAY

SEQ ID NO: 158 - protein, 234 aa, Homo sapiens
MQIMLSPEDQGPLDIEWLISPADNQKMDQVMILYSGNKIYDDYYPELKGRVHFKRNDLKSGDASINVTNLQLSDIGTDQCKVKKAPGVANKIQLVVLVKPSGTRCYVDGSEEIGSDFKLKCEPKEGSLPLQYEWQKLSDSQKMPTSWEDVPPPKSRTSAARSCIGSNHSSLGSMSPSNMEGYSKTQYKQVPSEDFERTPQSPTLPPAKVAAPNLSRMGVIPVMIPAQSKDGSIV

SEQ ID NO: 159 - protein, 180 aa, Homo sapiens
MIEKAKGETAYLPCKFTLSPEDQGPLDIEWLISPADNQKVDQVIILYSGDKNYDDYYPDLKGRVHFKSNDLKSGDASINVTNFQLSDIGTDQCKVKRAPGVANRKIQLVVLGKPSGTRCYVDGSEEIGSDFKLKCEPKEGSLPLQYEWQKLSDSQKMPTSWLAGKMCRLQRATRPLPEAT

SEQ ID NO: 160 - DNA, 2764 bp, Homo sapiens
gggaggaggggcggagggtgcagaggtgccgccgccgccgcgagccagtcgggagcgcgcgaggcgcggggagcctgggaccaggagcgagagccgcctacctgcagccgccgcccacggcacggcagccaccatggcgctcctgctgtgcttcgtgctcctgtgcggagtagtggatttcgccagaagtttgagtatcactactcctgaagagatgattgaaaaagccaaaggggaaactgcctatctgccatgcaaatttacgcttagtcccgaagaccagggaccgctggacatcgagtggctgatatcaccagctgataatcagaaggtggatcaagtgattattttatattctggagacaaaatttatgatgactactatccagatctgaaaggccgagtacattttacgagtaatgatctcaaatctggtgatgcatcaataaatgtaacgaatttacaactgtcagatattggcacatatcagtgcaaagtgaaaaaagctcctggtgttgcaaataagaagattcatctggtagttcttgttaagccttcaggtgcgagatgttacgttgatggatctgaagaaattggaagtgactttaagataaaatgtgaaccaaaagaaggttcacttccattacagtatgagtggcaaaaattgtctgactcacagaaaatgcccacttcatggttagcagggaagatgtgccacctccaaagagccgtacgtccactgccagaagctacatcggcagtaatcattcatccctggggtccatgtctccttccaacatggaaggatattccaagactcagtataaccaagtaccaagtgaagactttgaacgcactcctcagagtccgactctcccacctgctaaggtagctgcccctaatctaagtcgaatgggtgcgattcctgtgatgattccagcacagagcaaggatgggtctatagtatagagcctccatatgtctcatctgtgctctccgtgttcctttcctttttttgatatatgaaaacctattctggtctaaattgtgttactagcctcaaaatacatcaaaaaataagttaatcaggaactgtacggaatatatttttaaaaatttttgtttggttatatcgaaatagttacaggcactaaagttagtaaagaaaagtttaccatctgaaaaagctggattttctttaagaggttgattataaagttttctaaatttatcagtacctaagtaagatgtagcgctttgaatatgaaatcataggtgaagacatgggtgaacttacttgcataccaagttgatacttgaataaccatctgaaagtggtacttgatcatttttaccattatttttaggatgtgtatttcatttatttatggcccaccagtctcccccaaattagtacagaaatatccatgacaaaattacttacgtatgtttgtacttggttttacagctcctttgaaaactctgtgtttggaatatctctaaaaacatagaaaacactacagtggtttagaaattactaattttacttctaagtcattcataaaccttgtctatgaaatgacttcttaaatatttagttgatagactgctacaggtaatagggacttagcaagctcttttatatgctaaaggagcatctatcagattaagttagaacatttgctgtcagccacatattgagatgacactaggtgcaatagcagggatagattttgttggtgagtagtctcatgccttgagatctgtggtggtcttcaaaatggtggccagccagatcaaggatgtagtatctcatagttcccaggtgatatttttcttattagaaaaatattataactcatttgttgtttgacacttatagattgaaatttcctaatttattctaaattttaagtggttctttggttccagtgctttatgttgttgttgtttttggatggtgttacatattatatgttctagaaacatgtaatcctaaatttaccctcttgaatataatccctggatgatattttttatcataaatgcagaataatcaaatacattttaagcaagttaagtgtcctccatcaattctgtattccagacttgggaggatgtacagttgctgttgtgtgatcaaacatgtctctgtgtagttccagcaaatcaagctgagctttgaaaaagtttgtcttagttttgtgaaggtgatttattcttaaaaaaaaaaaagaaagaaaaagaaaaaaagataagaagaaggagtaaagggactactcctccttgccaaatgtgctaaatatcattttaggagaagaaagtgggtttattgtatttcccttaagattgtgagggagtgtggatacagtagaatgagccaacagtttctttataataaatacggtctgcaataaattatttcactagctctaaaacctttccctagattttagtagggagttggtttctgttaatatctttgggtgctgtggtggtaaatgctatattatgaacggtggcatgtatttacagttagagtattgtgtgtacactttttaatggtaaacttaagctgaatgtgtaatggatttgtgtatagttttacatatttggaagcattttaaaaacaggttttaaccttatgtaaaattacttttatactcgtgttaacattttcatctgtgccttttggtaatttaatttctattatgaatttctggtgcctatgagctagctatcacctacctgaaaggtgcttaga

SEQ ID NO: 161 - DNA, 3026 bp, Homo sapiens
gggaggaggggcggagggtgcagaggtgccgccgccgccgcgagccagtcgggagcgcgcgaggcgcggggagcctgggaccaggagcgagagccgcctacctgcagccgccgcccacggcacggcagccaccatggcgctcctgctgtgcttcgtgctcctgtgcggagtagtggatttcgccagaagtttgagtatcactactcctgaagagatgattgaaaaagccaaaggggaaactgcctatctgccatgcaaatttacgcttagtcccgaagaccagggaccgctggacatcgagtggctgatatcaccagctgataatcagaaggtggatcaagtgattattttatattctggagacaaaatttatgatgactactatccagatctgaaaggccgagtacattttacgagtaatgatctcaaatctggtgatgcatcaataaatgtaacgaatttacaactgtcagatattggcacatatcagtgcaaagtgaaaaaagctcctggtgttgcaaataagaagattcatctggtagttcttgttaagccttcaggtgcgagatgttacgttgatggatctgaagaaattggaagtgactttaagataaaatgtgaaccaaaagaaggttcacttccattacagtatgagtggcaaaaattgtctgactcacagaaaatgcccacttcatggttagcagaaatgacttcatctgttatatctgtaaaaaatgcctcttctgagtactctgggacatacagctgtacagtcagaaacagagtgggctctgatcagtgcctgttgcgtctaaacgttgtccctccttcaaataaagctggactaattgcaggagccattataggaactttgcttgctctagcgctcattggtcttatcatcttttgctgtcgtaaaaagcgcagagaagaaaaatatgaaaaggaagttcatcacgatatcagggaagatgtgccacctccaaagagccgtacgtccactgccagaagctacatcggcagtaatcattcatccctggggtccatgtctccttccaacatggaaggatattccaagactcagtataaccaagtaccaagtgaagactttgaacgcactcctcagagtccgactctcccacctgctaaggtagctgcccctaatctaagtcgaatgggtgcgattcctgtgatgattccagcacagagcaaggatgggtctatagtatagagcctccatatgtctcatctgtgctctccgtgttcctttcctttttttgatatatgaaaacctattctggtctaaattgtgttactagcctcaaaatacatcaaaaaataagttaatcaggaactgtacggaatatatttttaaaaatttttgtttggttatatcgaaatagttacaggcactaaagttagtaaagaaaagtttaccatctgaaaaagctggattttctttaagaggttgattataaagttttctaaatttatcagtacctaagtaagatgtagcgctttgaatatgaaatcataggtgaagacatgggtgaacttacttgcataccaagttgatacttgaataaccatctgaaagtggtacttgatcatttttaccattatttttaggatgtgtatttcatttatttatggcccaccagtctcccccaaattagtacagaaatatccatgacaaaattacttacgtatgtttgtacttggttttacagctcctttgaaaactctgtgtttggaatatctctaaaaacatagaaaacactacagtggtttagaaattactaattttacttctaagtcattcataaaccttgtctatgaaatgacttcttaaatatttagttgatagactgctacaggtaatagggacttagcaagctcttttatatgctaaaggagcatctatcagattaagttagaacatttgctgtcagccacatattgagatgacactaggtgcaatagcagggatagattttgttggtgagtagtctcatgccttgagatctgtggtggtcttcaaaatggtggccagccagatcaaggatgtagtatctcatagttcccaggtgatatttttcttattagaaaaatattataactcatttgttgtttgacacttatagattgaaatttcctaatttattctaaattttaagtggttctttggttccagtgctttatgttgttgttgtttttggatggtgttacatattatatgttctagaaacatgtaatcctaaatttaccctcttgaatataatccctggatgatattttttatcataaatgcagaataatcaaatacattttaagcaagttaagtgtcctccatcaattctgtattccagacttgggaggatgtacagttgctgttgtgtgatcaaacatgtctctgtgtagttccagcaaatcaagctgagctttgaaaaagtttgtcttagttttgtgaaggtgatttattcttaaaaaaaaaaaagaaagaaaaagaaaaaaagataagaagaaggagtaaagggactactcctccttgccaaatgtgctaaatatcattttaggagaagaaagtgggtttattgtatttcccttaagattgtgagggagtgtggatacagtagaatgagccaacagtttctttataataaatacggtctgcaataaattatttcactagctctaaaacctttccctagattttagtagggagttggtttctgttaatatctttgggtgctgtggtggtaaatgctatattatgaacggtggcatgtatttacagttagagtattgtgtgtacactttttaatggtaaacttaagctgaatgtgtaatggatttgtgtatagttttacatatttggaagcattttaaaaacaggttttaaccttatgtaaaattacttttatactcgtgttaacattttcatctgtgccttttggtaatttaatttctattatgaatttctggtgcctatgagctagctatcacctacctgaaaggtgcttaga

SEQ ID NO: 162 - DNA, 733 bp, Homo sapiens
gggaggaggggcggagggtgcagaggtgccgccgccgccgcgagccagtcgggagcgcgcgaggcgcggggagcctgggaccaggagcgagagccgcctacctgcagccgccgcccacggcacggcagccaccatggcgctcctgctgtgcttcgtgctcctgtgcggagtagtggatttcgccagaagtttgagtatcactactcctgaagagatgattgaaaaagccaaaggggaaactgcctatctgccatgcaaatttacgcttagtcccgaagaccagggaccgctggacatcgagtggctgatatcaccagctgataatcagaaggtggatcaagtgattattttatattctggagacaaaatttatgatgactactatccagatctgaaaggccgagtacattttacgagtaatgatctcaaatctggtgatgcatcaataaatgtaacgaatttacaactgtcagatattggcacatatcagtgcaaagtgaaaaaagctcctggtgttgcaaataagaagattcatctggtagttcttgggaagatgtgccacctccaaagagccgtacgtccactgccagaagctacatcggcagtaatcattcatccctggggtccatgtctccttccaacatggaaggatattccaagactcagtataaccaagtaccaagtgaagactttgaacgcactcctcagagtccgactctcccacctgctaagg

SEQ ID NO: 163 - DNA, 2302 bp, Homo sapiens
tcttgagtgcgcgaggcgcggggagcctaggacctggagcgagagccgcctacctgcagccgccgcccacggcacggcagccatcatggcgttcctgctgcgcttcgtgctcctgtgcggagtcgcggatttcaccagaagtttgagtatcactactcctgagcagatgattgaaaaagccaaaggggaaactacctatctgccatgcaaattatgcttagtcctgaagaccagggaccactggacattgagtggctgatatcaccagctgataatcagaagatggatcaagtgatgattttatattctggaaacaaaatttatgatgattactatccagaactgaaaggccgagtacattttaagagaaatgatctcaaatctggtgatgcttcaataaatgtaacgaatttacagctgtcagatattggcacagatcagtgcaaagtgaaaaaagctcctggtgttgcaaataagattcagctggtagttcttgttaagccttcaggtacaagatgttatgttgatggatcagaagaaattggaagtgactttaaactaaaatgtgaaccaaaagaaggttcacttccattacagtatgagtggcaaaaattgtctgactcacagaaaatgcccacttcatggttagcagaaatgacttcatctgttatatctgtaaaaaaaatgcttcttctgagtactctgggacatacagctgtacatcagaaacggagtgggctctgatcagtgcctgttgcgtgtaaacgttgtccctccttcaaataaagctggactaattgcaggagccattataggaactttgcttgctctagtgctcattggtcttatcatcttttgctgtcgtaaaaagcgcagagaagaaaaatacgaaaagtaagttcatcacgatatcagggaagatgtgccgcctccaaagagccgtacgtccgctgccagaagctgcataggcagtaatcattcatccctgggatccatgtctccttccaacatggaaggatattccaagactcagtataaacaagtaccgagtgaagactttgaacgcactcctcagagtccgactctcccacctgctaaggtagctgcccctaatctaagtcgaatgggcgtgattcctgtgatgattcccgcacagagcaaggatgggtctatagtatagagcctccatacgtctcatctgtgctctccgtgttcctttccttttttgatatatgaaaacctattctggtctaaattttgttactagcctcaaaatgtatccaaaaataagttaatcaggagctgtaaggaatatatttttttaaatttttctttggttatatcgaaatagttacaggcattaaagttagtaaagacaagtttaccatctgaaaaagctggattttctttaagaggttgattataaaggtttctaaatttatcagtacctaagtaagatgtagcactttgaatatgaaatcataagtgaagacattggtgaacttacttgcataccaagttgatacttgagtaaccatctgaaagtggtacttgataatttttaccgttatttttaggatgtgtatctcatttatttatggcccactagtctcccccaaattagtacagaaacatccatgacaaaattacacatgtgtgtttgtacttgttttcacagctccttggaaaactctgtgttaggaatatctctaaaaacatagaaaactctacagtggtttagaaattactaattttacttctaagtcattcataaaccttgtctatgaaatgatttcttaaatatttagttgatagactgctacaggtaatagggacttagcaagctcttttatatgctaaaggagcatctatcagattaagttagaacatttgctgtcagccacatattgagatgacactaggtgcaatagcagggatagattttgttggtgagtggtctcatgccttgagatctgtggtggtctttaaaatggtggccagccagatcaaggatgtagtatctcatagttctggactaaatactggctttccactttaggtgatatttttcttattagaaaaatattataactcatttattgtttgacagttatagattgaaatttcctaattctaaattttaagtggttcttcagtttcagtgctttatgttgtttgttgttggtttggcatggcattacatattatatgttctagaaacatgtaatcctaaatttaccctcttgaatatgatccctagatgatatttttatcataaatgcagaataatcaaatatatttt

SEQ ID NO: 164 - DNA, 400 bp, Homo sapiens
gggaggaggggcggagggtgcagaggtgccgccgccgccgcgagccagtcgggagcgcgcgaggcgcggggagcctgggaccaggagcgagagccgcctacctgcagccgccgcccacggcacggcagccaccatggcgctcctgctgtgcttcgtgctcctgtgcggagtagtggatttcgccagaagtttgagtatcactactcctgaagagatgattgaaaaagccaaaggggaaactgcctatctgccatgcaaatttacgcttagtcccgaagaccagggaccgctggacatcgagtggctgatatcaccagctgataatcagaaggtggatcaagtgggaagatgtgccacctccaaagagccgtacgtccactgccagaagctacatcggcag

SEQ ID NO: 165 - DNA, 3026 bp, Homo sapiens; identical to SEQ ID NO: 161

SEQ ID NO: 166 - DNA, 702 bp, Homo sapiens
atgcaaattatgcttagtcctgaagaccagggaccactggacattgagtggctgatatcaccagctgataatcagaagatggatcaagtgatgattttatattctggaaacaaaatttatgatgattactatccagaactgaaaggccgagtacattttaagagaaatgatctcaaatctggtgatgcttcaataaatgtaacgaatttacagctgtcagatattggcacagatcagtgcaaagtgaaaaaagctcctggtgttgcaaataagattcagctggtagttcttgttaagccttcaggtacaagatgttatgttgatggatcagaagaaattggaagtgactttaaactaaaatgtgaaccaaaagaaggttcacttccattacagtatgagtggcaaaaattgtctgactcacagaaaatgcccacttcatgggaagatgtgccgcctccaaagagccgtacgtccgctgccagaagctgcataggcagtaatcattcatccctgggatccatgtctccttccaacatggaaggatattccaagactcagtataaacaagtaccgagtgaagactttgaacgcactcctcagagtccgactctcccacctgctaaggtagctgcccctaatctaagtcgaatgggcgtgattcctgtgatgattcccgcacagagcaaggatgggtctatagta

SEQ ID NO: 167 - DNA, 1000 bp, Homo sapiens
gagtgcgccaggcgcggggagcctaggacctggagcgagagccgcctacctgcagccgccgcccacggcacggcagccaccgtggcgctcctgctgcgcttcgtgctcctgtgcagagtcgcggatttcatcagaggttggagtatcactactcctgagcagatgattgaaaaagccaaaggggaaactgcctatctgccatgcaaatttacgcttagtcctgaagaccagggaccactggacatcgagtggctgatatcaccagctgataatcagaaggtggatcaagtgattattttatattctggagacaaaaattatgatgactactatccagatctgaaaggccgagtacattttaagagtaatgatctcaaatctggtgatgcatcaataaatgtaacgaattttcagctgtcagatattggcacagatcagtgcaaagtgaaaagagctcctggtgttgcaaataggaagattcagctggtagttcttggtaagccttcaggtacaagatgttacgttgatggatcagaagaaattggaagtgactttaaattaaaatgtgaaccaaaagaaggttcacttccattacagtatgagtggcaaaaattgtctgactcacagaaaatgcccacttcatggttagcagggaagatgtgccgcctccaaagagccacacgtccactgccagaagctacataggcagtaatcattcatccctgggatccatatctccttccaacatggaaggatattccaagactcagtataaacaagtaccaagtgaagactttgaacgcactcctcagagtccgactctcccacctgctaaggtagctgcccctaatctaagtcgaatgggcgcgattcctgtgatgattcccgcacagagcaaggatgggtctatagtatagagcctccatacatctcatctgtgctctccgtgttcctttcctttttttgatatatgaaaacctattctggtctaaattttgtt

SEQ ID NO: 168 - protein, 1070 aa, Homo sapiens [sequence omitted]

SEQ ID NO: 169 - protein, 1014 aa, Homo sapiens
MGAARGSPARPRRLPLLSVLLLPLLGGTQTAIVFIKQPSSQDALQGRRALLRCEVEAPGPVHVYWLLDGAPVQDTERRFAQGSSLSFAAVDRLQDSGTFQCVARDDVTGEEARSANASFNIKWIEAGPVVLKHPASEAEIQPQTQVTLRCHIDGHPRPTYQWFRDGTPLSDGQSNHTVSSKERNLTLRPAGPEHSGLYSCCAHSAFGQACSSQNFTLSIADESFARVVLAPQDVVVARYEEAMFHCQFSAQPPPSLQWLFEDETPITNRSRPPHLRRATVFANGSLLLTQVRPRNAGIYRCIGQGQRGPPIILEATLHLAEIEDMPLFEPRVFTAGSEERVTCLPPKGLPEPSVWWEHAGVRLPTHGRVYQKGHELVLANIAESDAGVYTCHAANLAGQRRQDVNITVATVPSWLKKPQDSQLEEGKPGYLDCLTQATPKPTVVWYRNQMLISEDSRFEVFKNGTLRINSVEVYDGTWYRCMSSTPAGSIEAQARVQVLEKLKFTPPPQPQQCMEFDKEATVPCSATGREKPTIKWERADGSSLPEWVTDNAGTLHFARVTRDDAGNYTCIASNGPQGQIRAHVQLTVAVFITFKVEPERTTVYQGHTALLQCEAQGDPKPLIQWKDKPVPEESEGPGSPPPYKMIQTIGLSVGAAVAYIIAVLGLMFYCKKRCKAKRLQKQPEGEEPEMECLNGGPLQNGQPSAEIQEEVALTSLGSGPAATNKRHSTSDKMHFPRSSLQPITTLGKSEFGEVFLAKAQGLEEGVAETLVLVKSLQSKDEQQQLDFRRELEMFGKLNHANVVRLLGLCREAEPHYMVLEYVDLGDLKQFLRISKSKDEKLKSQPLSTKQKVALCTQVALGMEHLSNNRFVHKDLAARNCLVSAQRQVKVSALGLSKDVYNSEYYHFRQAWVPLRWMSPEAILEGDFSTKSDVWAFGVLMWEVFTHGEMPHGGQADDEVLADLQAGKARLPQPEGCPSKLYRLMQRCWALSPKDRPSFSEIASALGDSTVDSKP

SEQ ID NO: 170 - protein, 1030 aa, Homo sapiens
MGAARGSPARPRRLPLLSVLLLPLLGGTQTAIVFIKQPSSQDALQGRRALLRCEVEAPGPVHVYWLLDGAPVQDTERRFAQGSSLSFAAVDRLQDSGTFQCVARDDVTGEEARSANASFNIKWIEAGPVVLKHPASEAEIQPQTQVTLRCHIDGHPRPTYQWFRDGTPLSDGQSNHTVSSKERNLTLRPAGPEHSGLYSCCAHSAFGQACSSQNFTLSIADESFARVVLAPQDVVVARYEEAMFHCQFSAQPPPSLQWLFEDETPITNRSRPPHLRRATVFANGSLLLTQVRPRNAGIYRCIGQGQRGPPIILEATLHLAEIEDMPLFEPRVFTAGSEERVTCLPPKGLPEPSVWWEHAGVRLPTHGRVYQKGHELVLANIAESDAGVYTCHAANLAGQRRQDVNITVATVPSWLKKPQDSQLEEGKPGYLDCLTQATPKPTVVWYRNQMLISEDSRFEVFKNGTLRINSVEVYDGTWYRCMSSTPAGSIEAQARVQVLDGSSLPEWVTDNAGTLHFARVTRDDAGNYTCIASNGPQGQIRAHVQLTVAVFITFKVEPERTTVYQGHTALLQCEAQGDPKPLIQWKGKDRILDPTKLGPRMHIFQNGSLVIHDVAPEDSGRYTCIAGNSCNIKHTEAPLYVVDKPVPEESEGPGSPPPYKMIQTIGLSVGAAVAYIIAVLGLMFYCKKRCKAKRLQKQPEGEEPEMECLNGGPLQNGQPSAEIQEEVALTSLGSGPAATNKRHSTSDKMHFPRSSLQPITTLGKSEFGEVFLAKAQGLEEGVAETLVLVKSLQSKDEQQQLDFRRELEMFGKLNHANVVRLLGLCREAEPHYMVLEYVDLGDLKQFLRISKSKDEKLKSQPLSTKQKVALCTQVALGMEHLSNNRFVHKDLAARNCLVSAQRQVKVSALGLSKDVYNSEYYHFRQAWVPLRWMSPEAILEGDFSTKSDVWAFGVLMWEVFTHGEMPHGGQADDEVLADLQAGKARLPQPEGCPSKLYRLMQRCWALSPKDRPSFSEIASALGDSTVDSKP

SEQ ID NO: 171 - protein, 1070 aa, Homo sapiens
MGAARGSPARPRRLPLLSVLLLPLLGGTQTAIVFIKQPSSQDALQGRRALLRCEVEAPGPVHVYWLLDGAPVQDTERRFAQGSSLSFAAVDRLQDSGTFQCVARDDVTGEEARSANASFNIKWIEAGPVVLKHPASEAEIQPQTQVTLRCHIDGHPRPTYQWFRDGTPLSDGQSNHTVSSKERNLTLRPAGPEHSGLYSCCAHSAFGQACSSQNFTLSIADESFARVVLAPQDVVVARYEEAMFHCQFSAQPPPSLQWLFEDETPITNRSRPPHLRRATVFANGSLLLTQVRPRNAGIYRCIGQGQRGPPIILEATLHLAEIEDMPLFEPRVFTAGSEERVTCLPPKGLPEPSVWWEHAGVRLPTHGRVYQKGHELVLANIAESDAGVYTCHAANLAGQRRQDVNITVATVPSWLKKPQDSQLEEGKPGYLDCLTQATPKPTVVWYRNQMLISEDSRFEVFKNGTLRINSVEVYDGTWYRCMSSTPAGSIEAQARVQVLEKLKFTPPPQPQQCMEFDKEATVPCSATGREKPTIKWERADGSSLPEWVTDNAGTLHFARVTRDDAGNYTCIASNGPQGQIRAHVQLTVAVFITFKVEPERTTVYQGHTALLQCEAQGDPKPLIQWKGKDRILDPTKLGPRMHIFQNGSLVIHDVAPEDSGRYTCIAGNSCNIKHTEAPLYVVDKPVPEESEGPGSPPPYKMIQTIGLSVGAAVAYIIAVLGLMFYCKKRCKAKRLQKQPEGEEPEMECLNGGPLQNGQPSAEIQEEVALTSLGSGPAATNKRHSTSDKMHFPRSSLQPITTLGKSEFGEVFLAKAQGLEEGVAETLVLVKSLQSKDEQQQLDFRRELEMFGKLNHANVVRLLGLCREAEPHYMVLEYVDLGDLKQFLRISKSKDEKLKSQPLSTKQKVALCTQVALGMEHLSNNRFVHKDLAARNCLVSAQRQVKVSALGLSKDVYNSEYYHFRQAWVPLRWMSPEAILEGDFSTKSDVWAFGVLMWEVFTHGEMPHGGQADDEVLADLQAGKARLPQPEGCPSKLYRLMQRCWALSPKDRPSFSEIASALGDSTVDSKP

SEQ ID NO: 172 - protein, 726 aa, Homo sapiens [sequence omitted]

SEQ ID NO: 173 - protein, 816 aa, Homo sapiens
MGAARGSPARPRRLPLLSVLLLPLLGGTQTAIVFIKQPSSQDALQGRRALLRCEVEAPGPVHVYWLLDGAPVQDTERRFAQGSSLSFAAVDRLQDSGTFQCVARDDVTGEEARSANASFNIKWIEAGPVVLKHPASEAEIQPQTQVTLRCHIDGHPRPTYQWFRDGTPLSDGQSNHTVSSKERNLTLRPAGPEHSGLYSCCAHSAFGQACSSQNFTLSIADESFARVVLAPQDVVVARYEEAMFHCQFSAQPPPSLQWLFEDETPITNRSRPPHLRRATVFANGSLLLTQVRPRNAGIYRCIGQGQRGPPIILEATLHLAEIEDMPLFEPRVFTAGSEERVTCLPPKGLPEPSVWWEHAGVRLPTHGRVYQKGHELVLANIAESDAGVYTCHAANLAGQRRQDVNITVATVPSWLKKPQDSQLEEGKPGYLDCLTQATPKPTVVWYRNQMLISEDSRFEVFKNGTLRINSVEVYDGTWYRCMSSTPAGSIEAQARVQVLEKLKFTPPPQPQQCMEFDKEATVPCSATGREKPTIKWERADGSSLPEWVTDNAGTLHFARVTRDDAGNYTCIASNGPQGQIRAHVQLTVAVFITFKVEPERTTVYQGHTALLQCEAQGDPKPLIQWKGKDRILDPTKLGPRMHIFQNGSLVIHDVAPEDSGRYTCIAGNSCNIKHTEAPLYVVDKPVPEESEGPGSPPPYKMIQTIGLSVGAAVAYIIAVLGLMFYCKKRCKAKRLQKQPEGEEPEMECLNGGPLQNGQPSAEIQEEVALTSLGSGPAATNKRHSTSDKMHFPRSSLQPITTLGRPQAVPEDFQEQG

SEQ ID NO: 174 - protein, 940 aa, Homo sapiens
MGAARGSPARPRRLPLLSVLLLPLLGGTQTAIVFIKQPSSQDALQGRRALLRCEVEAPGPVHVYWLLDGAPVQDTERRFAQGSSLSFAAVDRLQDSGTFQCVARDDVTGEEARSANASFNIKWIEAGPVVLKHPASEAEIQPQTQVTLRCHIDGHPRPTYQWFRDGTPLSDGQSNHTVSSKERNLTLRPAGPEHSGLYSCCAHSAFGQACSSQNFTLSIADESFARVVLAPQDVVVARYEEAMFHCQFSAQPPPSLQWLFEDETPITNRSRPPHLRRATVFANGSLLLTQVRPRNAGIYRCIGQGQRGPPIILEATLHLAEIEDMPLFEPRVFTAGSEERVTCLPPKGLPEPSVWWEHAGVRLPTHGRVYQKGHELVLANIAESDAGVYTCHAANLAGQRRQDVNITVANGSSLPEWVTDNAGTLHFARVTRDDAGNYTCIASNGPQGQIRAHVQLTVAVFITFKVEPERTTVYQGHTALLQCEAQGDPKPLIQWKGKDRILDPTKLGPRMHIFQNGSLVIHDVAPEDSGRYTCIAGNSCNIKHTEAPLYVVDKPVPEESEGPGSPPPYKMIQTIGLSVGAAVAYIIAVLGLMFYCKKRCKAKRLQKQPEGEEPEMECLNGGPLQNGQPSAEIQEEVALTSLGSGPAATNKRHSTSDKMHFPRSSLQPITTLGKSEFGEVFLAKAQGLEEGVAETLVLVKSLQSKDEQQQLDFRRELEMFGKLNHANVVRLLGLCREAEPHYMVLEYVDLGDLKQFLRISKSKDEKLKSQPLSTKQKVALCTQVALGMEHLSNNRFVHKDLAARNCLVSAQRQVKVSALGLSKDVYNSEYYHFRQAWVPLRWMSPEAILEGDFSTKSDVWAFGVLMWEVFTHGEMPHGGQADDEVLADLQAGKARLPQPEGCPSKLYRLMQRCWALSPKDRPSFSEIASALGDSTVDSKP

SEQ ID NO: 175 - DNA, 4243 bp, Homo sapiens
gcggcgcgcggggactcggaggtactgggcgcgcgcggctccggctcgggacgcctcgggacgcctcggggtcgggctccggctgcggctgctgctgcggcgcccgcgctccggtgcgctccgcctcctgtgcccgccgcggagcgcagtctgcgcgcccgccgtgcgccctcagctccttttcctgagcccgccgcgatgggagctgcgcggggatccccggccagaccccgccggttgcctctgctcagcgtcctgctgctgccgctgctgggcggtacccagacagccattgtcttcatcaagcagccgtcctcccaggatgcactgcaggggcgccgggcgctgcttcgctgtgaggttgaggctccgggcccggtacatgtgtactggctgctcgatggggcccctgtccaggacacggagcggcgtttcgcccagggcagcagcctgagctttgcagctgtggaccggctgcaggactctggcaccttccagtgtgtggctcgggatgatgtcactggagaagaagcccgcagtgccaacgcctccttcaacatcaaatggattgaggcaggtcctgtggtcctgaagcatccagcctcggaagctgagatccagccacagacccaggtcacacttcgttgccacattgatgggcaccctcggcccacctaccaatggttccgagatgggacccccctttctgatggtcagagcaaccacacagtcagcagcaaggagcggaacctgacgctccggccagctggtcctgagcatagtgggctgtattcctgctgcgcccacagtgcttttggccaggcttgcagcagccagaacttcaccttgagcattgctgatgaaagctttgccagggtggtgctggcaccccaggacgtggtagtagcgaggtatgaggaggccatgttccattgccagttctcagcccagccacccccgagcctgcagtggctctttgaggatgagactcccatcactaaccgcagtcgccccccacacctccgcagagccacagtgtttgccaacgggtctctgctgctgacccaggtccggccacgcaatgcagggatctaccgctgcattggccaggggcagaggggcccacccatcatcctggaagccacacttcacctagcagagattgaagacatgccgctatttgagccacgggtgtttacagctggcagcgaggagcgtgtgacctgccttccccccaagggtctgccagagcccagcgtgtggtgggagcacgcgggagtccggctgcccacccatggcagggtctaccagaagggccacgagctggtgttggccaatattgctgaaagtgatgctggtgtctacacctgccacgcggccaacctggctggtcagcggagacaggatgtcaacatcactgtggccactgtgccctcctggctgaagaagccccaagacagccagctggaggagggcaaacccggctacttggattgcctgacccaggccacaccaaaacctacagttgtctggtacagaaaccagatgctcatctcagaggactcacggttcgaggtcttcaagaatgggaccttgcgcatcaacagcgtggaggtgtatgatgggacatggtaccgttgtatgagcagcaccccagccggcagcatcgaggcgcaagcccgtgtccaagtgctggaaaagctcaagttcacaccaccaccccagccacagcagtgcatggagtttgacaaggaggccacggtgccctgttcagccacaggccgagagaagcccactattaagtgggaacgggcagatgggagcagcctcccagagtgggtgacagacaacgctgggaccctgcattttgcccgggtgactcgagatgacgctggcaactacacttgcattgcctccaacgggccgcagggccagattcgtgcccatgtccagctcactgtggcagtttttatcaccttcaaagtggaaccagagcgtacgactgtgtaccagggccacacagccctactgcagtgcgaggcccagggggaccccaagccgctgattcagtggaaaggcaaggaccgcatcctggaccccaccaagctgggacccaggatgcacatcttccagaatggctccctggtgatccatgacgtggcccctgaggactcaggccgctacacctgcattgcaggcaacagctgcaacatcaagcacacggaggcccccctctatgtcgtggacaagcctgtgccggaggagtcggagggccctggcagccctcccccctacaagatgatccagaccattgggttgtcggtgggtgccgctgtggcctacatcattgccgtgctgggcctcatgttctactgcaagaagcgctgcaaagccaagcggctgcagaagcagcccgagggcgaggagccagagatggaatgcctcaacggtgggcctttgcagaacgggcagccctcagcagagatccaagaagaagtggccttgaccagcttgggctccggccccgcggccaccaacaaacgccacagcacaagtgataagatgcacttcccacggtctagcctgcagcccatcaccacgctggggaagagtgagtttggggaggtgttcctggcaaaggctcagggcttggaggagggagtggcagagaccctggtacttgtgaagagcctgcagagcaaggatgagcagcagcagctggacttccggagggagttggagatgtttgggaagctgaaccacgccaacgtggtgcggctcctggggctgtgccgggaggctgagccccactacatggtgctggaatatgtggatctgggagacctcaagcagttcctgaggatttccaagagcaaggatgaaaaattgaagtcacagcccctcagcaccaagcagaaggtggccctatgcacccaggtagccctgggcatggagcacctgtccaacaaccgctttgtgcataaggacttggctgcgcgtaactgcctggtcagtgcccagagacaagtgaaggtgtctgccctgggcctcagcaaggatgtgtacaacagtgagtactaccacttccgccaggcctgggtgccgctgcgctggatgtcccccgaggccatcctggagggtgacttctctaccaagtctgatgtctgggccttcggtgtgctgatgtgggaagtgtttacacatggagagatgccccatggtgggcaggcagatgatgaagtactggcagatttgcaggctgggaaggctagacttcctcagcccgagggctgcccttccaaactctatcggctgatgcagcgctgctgggccctcagccccaaggaccggccctccttcagtgagattgccagcgccctgggagacagcaccgtggacagcaagccgtgaggagggagcccgctcaggatggcctgggcaggggaggacatctctagagggaagctcacagcatgatgggcaagatccctgtcctcctgggccctgaggcccctgccctagtgcaacaggcattgctgaggtctgagcagggcctggcctttcctcctcttcctcaccctcatcctttgggaggctgacttggacccaaactgggcgactagggctttgagctgggcagttttccctgccacctcttcctctatcagggacagtgtgggtgccacaggtaaccccaatttctggccttcaacttctccccttgaccgggtccaactctgccactcatctgccaactttgcctggggagggctaggcttgggatgagctgggtttgtggggagttccttaatattctcaagttctgggcacacagggttaatgagtctcttggcccactggtcccacttgggggtctagaccaggattatagaggacacagcaagtgagtcctccccactctgggcttgtgcacactgacccagacccacgtcttccccacccttctctcctttcctcatcctaagtgcctggcagatgaaggagttttcaggagcttttgacactatataaaccgccctttttgtatgcaccacgggcggcttttatatgtaattgcagcgtggggtgggtgggcatgggaggtaggggtgggccctggagatgaggagggtgggccatccttaccccacacttttattgttgtcgttttttgtttgttttgtttttttgtttttgtttttgtttttacactcgctgctctcaataaataagccttttttac

SEQ ID NO: 176 - DNA, 4243 bp, Homo sapiens; identical to SEQ ID NO: 175

SEQ ID NO: 177 - DNA, 4243 bp, Homo sapiens; identical to SEQ ID NO: 175

SEQ ID NO: 178 - DNA, 4243 bp, Homo sapiens; identical to SEQ ID NO: 175

SEQ ID NO: 179 - DNA, 3211 bp, Homo sapiens
gcggcgcgcggggactcggaggtactgggcgcgcgcggctccggctcgggacgcctcgggacgcctcggggtcgggctccggctgcggctgctgctgcggcgcccgcgctccggtgcgctccgcctcctgtgcccgccgcggagcgcagtctgcgcgcccgccgtgcgccctcagctccttttcctgagcccgccgcgatgggagctgcgcggggatccccggccagaccccgccggttgcctctgctcagcgtcctgctgctgccgctgctgggcggtacccagacagccattgtcttcatcaagcagccgtcctcccaggatgcactgcaggggcgccgggcgctgcttcgctgtgaggttgaggctccgggcccggtacatgtgtactggctgctcgatggggcccctgtccaggacacggagcggcgtttcgcccagggcagcagcctgagctttgcagctgtggaccggctgcaggactctggcaccttccagtgtgtggctcgggatgatgtcactggagaagaagcccgcagtgccaacgcctccttcaacatcaaatggattgaggcaggtcctgtggtcctgaagcatccagcctcggaagctgagatccagccacagacccaggtcacacttcgttgccacattgatgggcaccctcggcccacctaccaatggttccgagatgggacccccctttctgatggtcagagcaaccacacagtcagcagcaaggagcggaacctgacgctccggccagctggtcctgagcatagtgggctgtattcctgctgcgcccacagtgcttttggccaggcttgcagcagccagaacttcaccttgagcattgctgatgaaagctttgccagggtggtgctggcaccccaggacgtggtagtagcgaggtatgaggaggccatgttccattgccagttctcagcccagccacccccgagcctgcagtggctctttgaggatgagactcccatcactaaccgcagtcgccccccacacctccgcagagccacagtgtttgccaacgggtctctgctgctgacccaggtccggccacgcaatgcagggatctaccgctgcattggccaggggcagaggggcccacccatcatcctggaagccacacttcacctagcagagattgaagacatgccgctatttgagccacgggtgtttacagctggcagcgaggagcgtgtgacctgccttccccccaagggtctgccagagcccagcgtgtggtgggagcacgcgggagtccggctgcccacccatggcagggtctaccagaagggccacgagctggtgttggccaatattgctgaaagtgatgctggtgtctacacctgccacgcggccaacctggctggtcagcggagacaggatgtcaacatcactgtggccactgtgccctcctggctgaagaagccccaagacagccagctggaggagggcaaacccggctacttggattgcctgacccaggccacaccaaaacctacagttgtctggtacagaaaccagatgctcatctcagagactgtacccacagggaagagtgagtttggggaggtgttcctggcaaaggctcagggcttggaggagggagtggcagagaccctggtacttgtgaagagcctgcagagcaaggatgagcagcagcagctggacttccggagggagttggagatgtttgggaagctgaaccacgccaacgtggtgcggctcctggggctgtgccgggaggctgagccccactacatggtgctggaatatgtggatctgggagacctcaagcagttcctgaggatttccaagagcaaggatgaaaaattgaagtcacagcccctcagcaccaagcagaaggtggccctatgcacccaggtagccctgggcatggagcacctgtccaacaaccgctttgtgcataaggacttggctgcgcgtaactgcctggtcagtgcccagagacaagtgaaggtgtctgccctgggcctcagcaaggatgtgtacaacagtgagtactaccacttccgccaggcctgggtgccgctgcgctggatgtcccccgaggccatcctggagggtgacttctctaccaagtctgatgtctgggccttcggtgtgctgatgtgggaagtgtttacacatggagagatgccccatggtgggcaggcagatgatgaagtactggcagatttgcaggctgggaaggctagacttcctcagcccgagggctgcccttccaaactctatcggctgatgcagcgctgctgggccctcagccccaaggaccggccctccttcagtgagattgccagcgccctgggagacagcaccgtggacagcaagccgtgaggagggagcccgctcaggatggcctgggcaggggaggacatctctagagggaagctcacagcatgatgggcaagatccctgtcctcctgggccctgaggcccctgccctagtgcaacaggcattgctgaggtctgagcagggcctggcctttcctcctcttcctcaccctcatcctttgggaggctgacttggacccaaactgggcgactagggctttgagctgggcagttttccctgccacctcttcctctatcagggacagtgtgggtgccacaggtaaccccaatttctggccttcaacttctccccttgaccgggtccaactctgccactcatctgccaactttgcctggggagggctaggcttgggatgagctgggtttgtggggagttccttaatattctcaagttctgggcacacagggttaatgagtctcttggcccactggtcccacttgggggtctagaccaggattatagaggacacagcaagtgagtcctccccactctgggcttgtgcacactgacccagacccacgtcttccccacccttctctcctttcctcatcctaagtgcctggcagatgaaggagttttcaggagcttttgacactatataaaccgccctttttgtatgcaccacgggcggcttttatatgtaattgcagcgtggggtgggtgggcatgggaggtaggggtgggccctggagatgaggagggtgggccatccttaccccacacttttattgttgtcgttttttgtttgttttgtttttttgtttttgtttttgtttttacactcgctgctctcaataaataagccttttttac

SEQ ID NO: 180 - DNA, 4243 bp, Homo sapiens; identical to SEQ ID NO: 175

SEQ ID NO: 181 - DNA, 3859 bp, Homo sapiens
gcggcgcgcggggactcggaggtactgggcgcgcgcggctccggctcgggacgcctcgggacgcctcggggtcgggctccggctgcggctgctgctgcggcgcccgcgctccggtgcgctccgcctcctgtgcccgccgcggagcgcagtctgcgcgcccgccgtgcgccctcagctccttttcctgagcccgccgcgatgggagctgcgcggggatccccggccagaccccgccggttgcctctgctcagcgtcctgctgctgccgctgctgggcggtacccagacagccattgtcttcatcaagcagccgtcctcccaggatgcactgcaggggcgccgggcgctgcttcgctgtgaggttgaggctccgggcccggtacatgtgtactggctgctcgatggggcccctgtccaggacacggagcggcgtttcgcccagggcagcagcctgagctttgcagctgtggaccggctgcaggactctggcaccttccagtgtgtggctcgggatgatgtcactggagaagaagcccgcagtgccaacgcctccttcaacatcaaatggattgaggcaggtcctgtggtcctgaagcatccagcctcggaagctgagatccagccacagacccaggtcacacttcgttgccacattgatgggcaccctcggcccacctaccaatggttccgagatgggacccccctttctgatggtcagagcaaccacacagtcagcagcaaggagcggaacctgacgctccggccagctggtcctgagcatagtgggctgtattcctgctgcgcccacagtgcttttggccaggcttgcagcagccagaacttcaccttgagcattgctgatgaaagctttgccagggtggtgctggcaccccaggacgtggtagtagcgaggtatgaggaggccatgttccattgccagttctcagcccagccacccccgagcctgcagtggctctttgaggatgagactcccatcactaaccgcagtcgccccccacacctccgcagagccacagtgtttgccaacgggtctctgctgctgacccaggtccggccacgcaatgcagggatctaccgctgcattggccaggggcagaggggcccacccatcatcctggaagccacacttcacctagcagagattgaagacatgccgctatttgagccacgggtgtttacagctggcagcgaggagcgtgtgacctgccttccccccaagggtctgccagagcccagcgtgtggtgggagcacgcgggagtccggctgcccacccatggcagggtctaccagaagggccacgagctggtgttggccaatattgctgaaagtgatgctggtgtctacacctgccacgcggccaacctggctggtcagcggagacaggatgtcaacatcactgtggccaatgggagcagcctcccagagtgggtgacagacaacgctgggaccctgcattttgcccgggtgactcgagatgacgctggcaactacacttgcattgcctccaacgggccgcagggccagattcgtgcccatgtccagctcactgtggcagtttttatcaccttcaaagtggaaccagagcgtacgactgtgtaccagggccacacagccctactgcagtgcgaggcccagggggaccccaagccgctgattcagtggaaaggcaaggaccgcatcctggaccccaccaagctgggacccaggatgcacatcttccagaatggctccctggtgatccatgacgtggcccctgaggactcaggccgctacacctgcattgcaggcaacagctgcaacatcaagcacacggaggcccccctctatgtcgtggacaagcctgtgccggaggagtcggagggccctggcagccctcccccctacaagatgatccagaccattgggttgtcggtgggtgccgctgtggcctacatcattgccgtgctgggcctcatgttctactgcaagaagcgctgcaaagccaagcggctgcagaagcagcccgagggcgaggagccagagatggaatgcctcaacggtgggcctttgcagaacgggcagccctcagcagagatccaagaagaagtggccttgaccagcttgggctccggccccgcggccaccaacaaacgccacagcacaagtgataagatgcacttcccacggtctagcctgcagcccatcaccacgctggggaagagtgagtttggggaggtgttcctggcaaaggctcagggcttggaggagggagtggcagagaccctggtacttgtgaagagcctgcagagcaaggatgagcagcagcagctggacttccggagggagttggagatgtttgggaagctgaaccacgccaacgtggtgcggctcctggggctgtgccgggaggctgagccccactacatggtgctggaatatgtggatctgggagacctcaagcagttcctgaggatttccaagagcaaggatgaaaaattgaagtcacagcccctcagcaccaagcagaaggtggccctatgcacccaggtagccctgggcatggagcacctgtccaacaaccgctttgtgcataaggacttggctgcgcgtaactgcctggtcagtgcccagagacaagtgaaggtgtctgccctgggcctcagcaaggatgtgtacaacagtgagtactaccacttccgccaggcctgggtgccgctgcgctggatgtcccccgaggccatcctggagggtgacttctctaccaagtctgatgtctgggccttcggtgtgctgatgtgggaagtgtttacacatggagagatgccccatggtgggcaggcagatgatgaagtactggcagatttgcaggctgggaaggctagacttcctcagcccgagggctgcccttccaaactctatcggctgatgcagcgctgctgggccctcagccccaaggaccggccctccttcagtgagattgccagcgccctgggagacagcaccgtggacagcaagccgtgaggagggagcccgctcaggatggcctgggcaggggaggacatctctagagggaagctcacagcatgatgggcaagatccctgtcctcctgggccctgaggcccctgccctagtgcaacaggcattgctgaggtctgagcagggcctggcctttcctcctcttcctcaccctcatcctttgggaggctgacttggacccaaactgggcgactagggctttgagctgggcagttttccctgccacctcttcctctatcagggacagtgtgggtgccacaggtaaccccaatttctggccttcaacttctccccttgaccgggtccaactctgccactcatctgccaactttgcctggggagggctaggcttgggatgagctgggtttgtggggagttccttaatattctcaagttctgggcacacagggttaatgagtctcttggcccactggtcccacttgggggtctagaccaggattatagaggacacagcaagtgagtcctccccactctgggcttgtgcacactgacccagacccacgtcttccccacccttctctcctttcctcatcctaagtgcctggcagatgaaggagttttcaggagcttttgacactatataaaccgccctttttgtatgcaccacgggcggcttttatatgtaattgcagcgtggggtgggtgggcatgggaggtaggggtgggccctggagatgaggagggtgggccatccttaccccacacttttattgttgtcgttttttgtttgttttgtttttttgtttttgtttttgtttttacactcgctgctctcaataaataagccttttttacaacctg

SEQ ID NO: 182 - protein, 1400 aa, Homo sapiens
MELLPPLPQSFLLLLLLPAKPAAGEDWQCPRTPYAASRDFDVKYVVPSFSAGGLVQAMVTYEGDRNESAVFVAIRNRLHVLGPDLKSVQSLATGPAGDPGCQTCAACGPGPHGPPGDTDTKVLVLDPALPALVSCGSSLQGRCFLHDLEPQGTAVHLAAPACLFSAHHNRPDDCPDCVASPLGTRVTVVEQGQASYFYVASSLDAAVAGSFSPRSVSIRRLKADASGFAPGFVALSVLPKHLVSYSIEYVHSFHTGAFVYFLTVQPASVTDDPSALHTRLARLSATEPELGDYRELVLDCRFAPKRRRRGAPEGGQPYPVLQVAHSAPVGAQLATELSIAEGQEVLFGVFVTGKDGGPGVGPNSVVCAFPIDLLDTLIDEGVERCCESPVHPGLRRGLDFFQSPSFCPNPPGLEALSPNTSCRHFPLLVSSSFSRVDLFNGLLGPVQVTALYVTRLDNVTVAHMGTMDGRILQVELVRSLNYLLYVSNFSLGDSGQPVQRDVSRLGDHLLFASGDQVFQVPIRGPGCRHFLTCGRCLRAWHFMGCGWCGNMCGQQKECPGSWQQDHCPPKLTEFHPHSGPLRGSTRLTLCGSNFYLHPSGLVPEGTHQVTVGQSPCRPLPKDSSKLRPVPRKDFVEEFECELEPLGTQAVGPTNVSLTVTNMPPGKHFRVDGTSVLRGFSFMEPVLIAVQPLFGPRAGGTCLTLEGQSLSVGTSRAVLVNGTECLLARVSEGQLLCATPPGATVASVPLSLQVGGAQVPGSWTFQYREDPVVLSISPNCGYINSHITICGQHLTSAWHLVLSFHDGLRAVESRCERQLPEQQLCRLPEYVVRDPQGWVAGNLSARGDGAAGFTLPGFRFLPPPHPPSANLVPLKPEEHAIKFEYIGLGAVADCVGINVTVGGESCQHEFRGDMVVCPLPPSLQLGQDGAPLQVCVDGECHILGRVVRPGPDGVPQSTLLGILLPLLLLVAALATALVFSYWWRRKQLVLPPNLNDLASLDQTAGATPLPILYSGSDYRSGLALPAIDGLDSTTCVHGASFSDSEDESCVPLLRKESIQLRDLDSALLAEVKDVLIPHERVVTHSDRVIGKGHFGVVYHGEYIDQAQNRIQCAIKSLSRITEMQQVEAFLREGLLMRGLNHPNVLALIGIMLPPEGLPHVLLPYMCHGDLLQFIRSPQRNPTVKDLISFGLQVARGMEYLAEQKFVHRDLAARNCMLDESFTVKVADFGLARDILDREYYSVQQHRHARLPVKWMALESLQTYRFTTKSDVWSFGVLLWELLTRGAPPYRHIDPFDLTHFLAQGRRLPQPEYCPDSLYQVMQQCWEADPAVRPTFRVLVGEVEQIVSALLGDHYVQLPATYMNLGPSTSHEMNVRPEQPQFSPMPGNVRRPRPLSEPPRPT

SEQ ID NO: 183 - protein, 1400 aa, Homo sapiens [sequence omitted]

SEQ ID NO: 184 - DNA, 4743 bp, Homo sapiens
gaggcggctggggcgttgctgtcgtgcgtccgcaggcgtcaggtgctcagacccgagggccgggaagggatttgggtttcacaggaacctggggcgggggtccgctatcttggggctgtcgggaccgctgcttaaatttggcccagtccagacctcgagtcgggcccccagccaggcccacgcccaggtccaggcccaggccggtagggatcctctagggtcccagctcgcctcgatggagctcctcccgccgctgcctcagtccttcctgttgctgctgctgttgcctgccaagcccgcggcgggcgaggactggcagtgcccgcgcaccccctacgcggcctctcgcgactttgacgtgaagtacgtggtgcccagcttctccgccggaggcctggtacaggccatggtgacctacgagggcgacagaaatgagagtgctgtgtttgtagccatacgcaatcgcctgcatgtgcttgggcctgacctgaagtctgtccagagcctggccacgggccctgctggagaccctggctgccagacgtgtgcagcctgtggcccaggaccccacggccctcccggtgacacagacacaaaggtgctggtgctggatcccgcgctgcctgcgctggtcagttgtggctccagcctgcagggccgctgcttcctgcatgacctagagccccaagggacagccgtgcatctggcagcgccagcctgcctcttctcagcccaccataaccggcccgatgactgccccgactgtgtggccagcccattgggcacccgtgtaactgtggttgagcaaggccaggcctcctatttctacgtggcatcctcactggacgcagccgtggctgccagcttcagcccacgctcagtgtctatcaggcgtctcaaggctgacgcctcgggattcgcaccgggctttgtggcgttgtcagtgctgcccaagcatcttgtctcctacagtattgaatacgtgcacagcttccacacgggagccttcgtatacttcctgactgtacagccggccagcgtgacagatgatcctagtgccctgcacacacgcctggcacggcttagcgccactgagccagagttgggtgactatcgggagctggtcctcgactgcagatttgctccaaaacgcaggcgccggggggccccagaaggcggacagccctaccctgtgctgcgggtggcccactccgctccagtgggtgcccaacttgccactgagctgagcatcgccgagggccaggaagtactatttggggtctttgtgactggcaaggatggtggtcctggcgtgggccccaactctgtcgtctgtgccttccccattgacctgctggacacactaattgatgagggtgtggagcgctgttgtgaatccccagtccatccaggcctccggcgaggcctcgacttcttccagtcgcccagtttttgccccaacccgcctggcctggaagccctcagccccaacaccagctgccgccacttccctctgctggtcagtagcagcttctcacgtgtggacctattcaatgggctgttgggaccagtacaggtcactgcattgtatgtgacacgccttgacaacgtcacagtggcacacatgggcacaatggatgggcgtatcctgcaggtggagctggtcaggtcactaaactacttgctgtatgtgtccaacttctcactgggtgacagtgggcagcccgtgcagcgggatgtcagtcgtcttggggaccacctactctttgcctctggggaccaggttttccaggtacctatccgaggccctggctgccgccacttcctgacctgtgggcgttgcctaagggcatggcatttcatgggctgtggctggtgtgggaacatgtgcggccagcagaaggagtgtcctggctcctggcaacaggaccactgcccacctaagcttactgagttccacccccacagtggacctctaaggggcagtacaaggctgaccctgtgtggctccaacttctaccttcacccttctggtctggtgcctgagggaacccatcaggtcactgtgggccaaagtccctgccggccactgcccaaggacagctcaaaactcagaccagtgccccggaaagactttgtagaggagtttgagtgtgaactggagcccttgggcacccaggcagtggggcctaccaacgtcagcctcaccgtgactaacatgccaccgggcaagcacttccgggtagacggcacctccgtgctgagaggcttctctttcatggagccagtgctgatagcagtgcaacccctctttggcccacgggcaggaggcacctgtctcactcttgaaggccagagtctgtctgtaggcaccagccgggctgtgctggtcaatgggactgagtgtctgctagcacgggtcagtgaggggcagcttttatgtgccacaccccctggggccacggtggccagtgtcccccttagcctgcaggtggggggtgcccaggtacctggttcctggaccttccagtacagagaagaccctgtcgtgctaagcatcagccccaactgtggctacatcaactcccacatcaccatctgtggccagcatctaacttcagcatggcacttagtgctgtcattccatgacgggcttagggcagtggaaagcaggtgtgagaggcagcttccagagcagcagctgtgccgccttcctgaatatgtggtccgagacccccagggatgggtggcagggaatctgagtgcccgaggggatggagctgctggctttacactgcctggctttcgcttcctacccccaccccatccacccagtgccaacctagttccactgaagcctgaggagcatgccattaagtttgagtatattgggctgggcgctgtggctgactgtgtgggtatcaacgtgaccgtgggtggtgagagctgccagcacgagttccggggggacatggttgtctgccccctgcccccatccctgcagcttggccaggatggtgccccattgcaggtctgcgtagatggtgaatgtcatatcctgggtagagtggtgcggccagggccagatggggtcccacagagcacgctccttggtatcctgctgcctttgctgctgcttgtggctgcactggcgactgcactggtcttcagctactggtggcggaggaagcagctagttcttcctcccaacctgaatgacctggcatccctggaccagactgctggagccacacccctgcctattctgtactcgggctctgactacagaagtggccttgcactccctgccattgatggtctggattccaccacttgtgtccatggagcatccttctccgatagtgaagatgaatcctgtgtgccactgctgcggaaagagtccatccagctaagggacctggactctgcgctcttggctgaggtcaaggatgtgctgattccccatgagcgggtggtcacccacagtgaccgagtcattggcaaaggccactttggagttgtctaccacggagaatacatagaccaggcccagaatcgaatccaatgtgccatcaagtcactaagtcgcatcacagagatgcagcaggtggaggccttcctgcgagaggggctgctcatgcgtggcctgaaccacccgaatgtgctggctctcattggtatcatgttgccacctgagggcctgccccatgtgctgctgccctatatgtgccacggtgacctgctccagttcatccgctcacctcagcggaaccccaccgtgaaggacctcatcagctttggcctgcaggtagcccgcggcatggagtacctggcagagcagaagtttgtgcacagggacctggctgcgcggaactgcatgctggacgagtcattcacagtcaaggtggctgactttggtttggcccgcgacatcctggacagggagtactatagtgttcaacagcatcgccacgctcgcctacctgtgaagtggatggcgctggagagcctgcagacctatagatttaccaccaagtctgatgtgtggtcatttggtgtgctgctgtgggaactgctgacacggggtgccccaccataccgccacattgacccttttgaccttacccacttcctggcccagggtcggcgcctgccccagcctgagtattgccctgattctctgtaccaagtgatgcagcaatgctgggaggcagacccagcagtgcgacccaccttcggagtactagtgggggaggtggagcagatagtgtctgcactgcttggggaccattatgtgcagctgccagcaacctacatgaacttgggccccagcacctcgcatgagatgaatgtgcgtccagaacagccgcagttctcacccatgccagggaatgtacgccggccccggccactctcagagcctcctcggcccacttgacttagttcttgggctggacctgcttagctgccttgagctaaccccaagctgcctctgggccatgccaggccagagggcagtggccctccaccttgttcctgccctttaactttcagaggcaataggtaaatggggcccattaggtccctcactccacagagtgagccagtgagggcagtcctgcaacatgtatttatggagtgcctgctgtggaccctgtcttctgggcacagtggactcagcagtgaccacaccaacactgacccttgaaccaataaaggaacaaatgactattaaagcacaaa

SEQ ID NO: 185 - DNA, 4743 bp, Homo sapiens; identical to SEQ ID NO: 184

SEQ ID NO: 186 - DNA, 31 bp, Artificial Sequence
  Primer
ggggacaagtttgtacaaaaaagcaggcttc

SEQ ID NO: 187 - DNA, 29 bp, Artificial Sequence
  Primer
ggggaccactttgtacaagaaagctgggt

SEQ ID NO: 188 - DNA, 2919 bp, Homo sapiens
ggccagaagaaatctggcctcggaacacgccattctccgcgccgcttccaataaccactaacatccctaacgagcatccgagccgagggctctgctcggaaatcgtcctggcccaactcggcccttcgagctctcgaagattaccgcatctatttttttttcttttttttcttttcctagcgcagataaagtgagcccggaaagggaaggagggggcggggacaccattgccctgaaagaataaataagtaaataaacaaactggctcctcgccgcagctggacgcggtcggttgagtccaggttgggtcggacctgaacccctaaaagcggaaccgcctcccgccctcgccatcccggagctgagtcgccggcggcggtggctgctgccagacccggagtttcctctttcactggatggagctgaactttgggcggccagagcagcacagctgtccggggatcgctgcacgctgagctccctcggcaagacccagcggcggctcgggatttttttgggggggcggggaccagccccgcgccggcaccatgttcctggcgaccctgtacttcgcgctgccgctcttggacttgctcctgtcggccgaagtgagcggcggagaccgcctggattgcgtgaaagccagtgatcagtgcctgaaggagcagagctgcagcaccaagtaccgcacgctaaggcagtgcgtggcgggcaaggagaccaacttcagcctggcatccggcctggaggccaaggatgagtgccgcagcgccatggaggccctgaagcagaagtcgctctacaactgccgctgcaagcggggtatgaagaaggagaagaactgcctgcgcatttactggagcatgtaccagagcctgcagggaaatgatctgctggaggattccccatatgaaccagttaacagcagattgtcagatatattccgggtggtcccattcatatcagatgtttttcagcaagtggagcacattcccaaagggaacaactgcctggatgcagcgaaggcctgcaacctcgacgacatttgcaagaagtacaggtcggcgtacatcaccccgtgcaccaccagcgtgtccaacgatgtctgcaaccgccgcaagtgccacaaggccctccggcagttctttgacaaggtcccggccaagcacagctacggaatgctcttctgctcctgccgggacatcgcctgcacagagcggaggcgacagaccatcgtgcctgtgtgctcctatgaagagagggagaagcccaactgtttgaatttgcaggactcctgcaagacgaattacatctgcagatctcgccttgcggatttttttaccaactgccagccagagtcaaggtctgtcagcagctgtctaaaggaaaactacgctgactgcctcctcgcctactcggggcttattggcacagtcatgacccccaactacatagactccagtagcctcagtgtggccccatggtgtgactgcagcaacagtgggaacgacctagaagagtgcttgaaatttttgaatttcttcaaggacaatacatgtcttaaaaatgcaattcaagcctttggcaatggctccgatgtgaccgtgtggcagccagccttcccagtacagaccaccactgccactaccaccactgccctccgggttaagaacaagcccctggggccagcagggtctgagaatgaaattcccactcatgttttgccaccgtgtgcaaatttacaggcacagaagctgaaatccaatgtgtcgggcaatacacacctctgtatttccaatggtaattatgaaaaagaaggtctcggtgcttccagccacataaccacaaaatcaatggctgctcctccaagctgtggtctgagcccactgctggtcctggtggtaaccgctctgtccaccctattatctttaacagaaacatcatagctgcattaaaaaaatacaatatggacatgtaaaaagacaaaaaccaagttatctgtttcctgttctcttgtatagctgaaattccagtttaggagctcagttgagaaacagttccattcaactggaacattttttttttttccttttaagaaagcttcttgtgatcctttggggcttctgtgaaaaacctgatgcagtgctccatccaaactcagaaggctttgggatatgctgtattttaaagggacagtttgtaacttgggctgtaaagcaaactggggctgtgttttcgatgatgatgatgatcatgatgatgatcatcatgatcatgatgatgatcatcatgatcatgatgatgattttaacagttttacttctggcctttcctagctagagaaggagttaatatttctaaggtaactcccatatctcctttaatgacattgatttctaatgatataaatttcagcctacattgatgccaagcttttttgccacaaagaagattcttaccaagagtgggctttgtggaaacagctggtactgatgttcacctttatatatgtactagcattttccacgctgatgtttatgtactgtaaacagttctgcactcttgtacaaaagaaaaaacacctgtcacatccaaatatagtatctgtcttttcgtcaaaatagagagtggggaatgagtgtgccgattcaatacctcaatccctgaacgacactctcctaatcctaagccttacctgagtgagaagccctttacctaacaaaagtccaatatagctgaaatgtcgctctaatactctttacacatatgaggttatatgtagaaaaaaattttactactaaatgatttcaactattggctttctatattttgaaagtaatgatattgtctcatttttttactgatggtttaatacaaaatacacagagcttctttcccctcaaaaaaaaaaaaaaaaaa

SEQ ID NO: 189 - DNA, 2856 bp, Homo sapiens
gtaaccgctactcccggacaccagaccaccgccttccgtacacaggggcccgcatcccaccctcccggacctaagagcctgggtcccctgtttccggaggtccgcttcccggcccccagattctggcatcccagccctcagtgtccaagacccaggcagcccgggtccccgcctcccggatccaggcgtccgggatctgcgccaccagaacctagcctcctgcagacctccgccatctgggggcactcaacctcctggagccaagggccccacgtcccacccagagaaactctcgtattcccagctcctagggccaaggaacccgggcgctccgaactcccagctttcggacatctggcacacggggcagagcagagaagctcagcgcccagcctggggaatttaaacactccagcttccaagagccaaggaacttcagtgctgtgaactcacaactctaaggagccctccaaagttccagtctccaggtgctgttactcaactcagtcctaggaacgtcgggtcctgggaaggagcccaagcgctcccagccagcttccaggcgctaagaaaccccggtgcttcccatcatggtggccgatcctcctcgagactccaaggggctcgcagcggcggagcccaccgccaacgggggcctggcgctggcctccatcgaggaccaaggcgcggcagcaggcggctactgcggttcccgggaccaggtgcgccgctgccttcgagccaacctgcttgtgctgctgacagtggtggccgtggtggccggcgtggcgctgggactgggggtgtcgggggccgggggtgcgctggcgttgggcccggagcgcttgagcgccttcgtcttcccgggcgagctgctgctgcgtctgctgcggatgatcatcttgccgctggtggtgtgcagcttgatcggcggcgccgccagcctggaccccggcgcgctcggccgtctgggcgcctgggcgctgctctttttcctggtcaccacgctgctggcgtcggcgctcggagtgggcttggcgctggctctgcagccgggcgccgcctccgccgccatcaacgcctccgtgggagccgcgggcagtgccgaaaatgcccccagcaaggaggtgctcgattcgttcctggatcttgcgagaaatatcttcccttccaacctggtgtcagcagcctttcgctcatactctaccacctatgaagagaggaatatcaccggaaccagggtgaaggtgcccgtggggcaggaggtggaggggatgaacatcctgggcttggtagtgtttgccatcgtctttggtgtggcgctgcggaagctggggcctgaaggggagctgcttatccgcttcttcaactccttcaatgaggccaccatggttctggtctcctggatcatgtggtacgcccctgtgggcatcatgttcctggtggctggcaagatcgtggagatggaggatgtgggtttactctttgcccgccttggcaagtacattctgtgctgcctgctgggtcacgccatccatgggctcctggtactgcccctcatctacttcctcttcacccgcaaaaacccctaccgcttcctgtggggcatcgtgacgccgctggccactgcctttgggacctcttccagttccgccacgctgccgctgatgatgaagtgcgtggaggagaataatggcgtggccaagcacatcagccgtttcatcctgcccatcggcgccaccgtcaacatggacggtgccgcgctcttccagtgcgtggccgcagtgttcattgcacagctcagccagcagtccttggacttcgtaaagatcatcaccatcctggtcacggccacagcgtccagcgtgggggcagcgggcatccctgctggaggtgtcctcactctggccatcatcctcgaagcagtcaacctcccggtcgaccatatctccttgatcctggctgtggactggctagtcgaccggtcctgtaccgtcctcaatgtagaaggtgacgctctgggggcaggactcctccaaaattatgtggaccgtacggagtcgagaagcacagagcctgagttgatacaagtgaagagtgagctgcccctggatccgctgccagtccccactgaggaaggaaaccccctcctcaaacactatcgggggcccgcaggggatgccacggtcgcctctgagaaggaatcagtcatgtaaaccccgggagggaccttccctgccctgctgggggtgctctttggacactggattatgaggaatggataaatggatgagctagggctctgggggtctgcctgcacactctggggagccaggggccccagcaccctccaggacaggagatctgggatgcctggctgctggagtacatgtgttcacaagggttactcctcaaaacccccagttctcactcatgtccccaactcaaggctagaaaacagcaagatggagaaataatgttctgctgcgtccccaccgtgacctgcctggcctcccctgtctcagggagcaggtcacaggtcaccatggggaattctagcccccactggggggatgttacaacaccatgctggttattttggcggctgtagttgtggggggatgtgtgtgtgcacgtgtgtgtgtgtgtgtgtgtgtgtgtgtgtgtgtgttctgtgacctcctgtccccatggtacgtcccaccctgtccccagatcccctattccctccacaataacagaaacactcccagggactctggggagaggctgaggacaaatacctgctgtcactccagaggacattttttttagcaataaaattgagtgtcaactatttaaaaaaaaaaaaaaaaa

SEQ ID NO: 190 - DNA, 4760 bp, Homo sapiens
gaaagaggcagcttacacacgccttccagtccctctactcagagcagcccggagaccgctgccgccgctgccgctgctaccaccgctgccacctgaggagacccgccgcccccccgtcgccgcctcctgcgagtccttcttagcacctggcgtttcatgcacattgccactgccattattattatcattccaatacaaggaaaataaaagaagataccagcgaaaagaaccgcttacacctttccgaattactcaagtgtctcctggaaacagagggtcgttgtccccggaggagcagccgaagggcccgtgggctggtgttgaccgggagggaggaggagttgggggcattgcgtggtggaaagttgcgtgcggcagagaaccgaaggtgcagcgccacagcccaggggacggtgtgtctgggagaagacgctgcccctgcgtcgggacccgccagcgcgcgggcaccgcggggcccgggacgacgccccctcctgcggcgtggactccgtcagtggcccaccaagaaggaggaggaatatggaatccaagggggccagttcctgccgtctgctcttctgcctcttgatctccgccaccgtcttcaggccaggccttggatggtatactgtaaattcagcatatggagataccattatcataccttgccgacttgacgtacctcagaatctcatgtttggcaaatggaaatatgaaaagcccgatggctccccagtatttattgccttcagatcctctacaaagaaaagtgtgcagtacgacgatgtaccagaatacaaagacagattgaacctctcagaaaactacactttgtctatcagtaatgcaaggatcagtgatgaaaagagatttgtgtgcatgctagtaactgaggacaacgtgtttgaggcacctacaatagtcaaggtgttcaagcaaccatctaaacctgaaattgtaagcaaagcactgtttctcgaaacagagcagctaaaaaagttgggtgactgcatttcagaagacagttatccagatggcaatatcacatggtacaggaatggaaaagtgctacatccccttgaaggagcggtggtcataatttttaaaaaggaaatggacccagtgactcagctctataccatgacttccaccctggagtacaagacaaccaaggctgacatacaaatgccattcacctgctcggtgacatattatggaccatctggccagaaaacaattcattctgaacaggcagtatttgatatttactatcctacagagcaggtgacaatacaagtgctgccaccaaaaaatgccatcaaagaaggggataacatcactcttaaatgcttagggaatggcaaccctcccccagaggaatttttgttttacttaccaggacagcccgaaggaataagaagctcaaatacttacacactgacggatgtgaggcgcaatgcaacaggagactacaagtgttccctgatagacaaaaaaagcatgattgcttcaacagccatcacagttcactatttggatttgtccttaaacccaagtggagaagtgactagacagattggtgatgccctacccgtgtcatgcacaatatctgctagcaggaatgcaactgtggtatggatgaaagataacatcaggcttcgatctagcccgtcattttctagtcttcattatcaggatgctggaaactatgtctgcgaaactgctctgcaggaggttgaaggactaaagaaaagagagtcattgactctcattgtagaaggcaaacctcaaataaaaatgacaaagaaaactgatcccagtggactatctaaaacaataatctgccatgtggaaggttttccaaagccagccattcaatggacaattactggcagtggaagcgtcataaaccaaacagaggaatctccttatattaatggcaggtattatagtaaaattatcatttcccctgaagagaatgttacattaacttgcacagcagaaaaccaactggagagaacagtaaactccttgaatgtctctgctataagtattccagaacacgatgaggcagacgagataagtgatgaaaacagagaaaaggtgaatgaccaggcaaaactaattgtgggaatcgttgttggtctcctccttgctgcccttgttgctggtgtcgtctactggctgtacatgaagaagtcaaagactgcatcaaaacatgtaaacaaggacctcggtaatatggaagaaaacaaaaagttagaagaaaacaatcacaaaactgaagcctaagagagaaactgtcctagttgtccagagataaaaatcatatagaccaattgaagcatgaacgtggattgtatttaagacataaacaaagacattgacagcaattcatggttcaagtattaagcagttcattctaccaagctgtcacaggttttcagagaattatctcaagtaaaacaaatgaaatttaattacaaacaataagaacaagttttggcagccatgataataggtcatatgttgtgtttggttcaattttttttccgtaaatgtctgcactgaggatttctttttggtttgccttttatgtaaattttttacgtagctatttttatacactgtaagctttgttctgggagttgctgttaatctgatgtataatgtaatgtttttatttcaattgtttatatggataatctgagcaggtacatttctgattctgattgctatcagcaatgccccaaactttctcataagcacctaaaacccaaaggtggcagcttgtgaagattggggacactcatattgccctaattaaaaactgtgatttttatcacaagggaggggaggccgagagtcagactgatagacaccataggagccgactctttgatatgccaccagcgaactctcagaaataaatcacagatgcatatagacacacatacataatggtactcccaaactgacaattttacctattctgaaaaagacataaaacagaatttggtagcacttacctctacagacacctgctaataaattattttctgtcaaaagaaaaaacacaagcatgtgtgagagacagtttggaaaaatcatggtcaacattcccattttcatagatcacaatgtaaatcactataattacaaattggtgttaaatcctttgggttatccactgccttaaaattatacctatttcatgtttaaaaagatatcaatcagaattggagtttttaacagtggtcattatcaaagctgtgttattttccacagaatatagaatatatatttttttcgtgtgtgtttttgttaactaccctacagatattgaatgcaccttgagataatttagtgtttttaactgatacataatttatcaagcagtacatgaaagtgtaataataaaatgtctatgtatctttagttacattcaaatttgtaactttataaacatgttttatgcttgaggaaatttttaaggtggtagtataaatggaaactttttgaagtagaccagatatgggctacttgtgactagacttttaaactttgctctttcaagcagaagcctggtttctgggagaacactgcacagcgatttctttcccaggatttacacaactttaaagggaagataaatgaacatcagatttctaggtatagaactatgttattgaaaggaaaaggaaaactggtgtttgtttcttagactcatgaaataaaaaattatgaaggcaatgaaaaataaattgaaaattaaagtcagatgagaataggaataatactttgccacttctgcattatttagaaacatacgttattgtacatttgtaaaccatttactgtctgggcaatagtgactccgtttaataaaagcttccgtagtgcattggtatggattaaatgcataaaatattcttagactcgatgctgtataaaatattatgggaaaaaaagaaaatatgttattttgcctctaaacttttattgaagttttatttggcaggaaaaaaaattgaatcttggtcaacatttaaaccaaagtaaaaggggaaaaaccaaagttatttgttttgcatggctaagccattctgttatctctgtaaatactgtgatttcttttttattttctctttagaattttgttaaagaaattctaaaatttttaaacacctgctctccacaataaatcacaaacactaaaataaaattacttccatataaatattattttctcttttggtgtgggagatcaaaggtttaaagtctaacttctaagatatatttgcagaaagaagcaacatgacaatagagagagttatgctacaattatttcttggtttccacttgcaatggttaattaagtccaaaaacagctgtcagaacctcgagagcagaacatgagaaactcagagctctggaccgaaagcagaaagtttgccgggaaaaaaaaagacaacattattaccatcgattcagtgcctggataaagaggaaagcttacttgtttaatggcagccacatgcacgaagatgctaagaagaaaaagaattccaaatcctcaacttttgaggtttcggctctccaatttaactctttggcaacaggaaacaggttttgcaagttcaaggttcactccctatatgtgattataggaattgtttgtggaaatggattaacatacccgtctatgcctaaaagataataaaactgaaatatgtcttcaaaaaaaaaaaaaaaaaaaa

SEQ ID NO: 191 - DNA, 1146 bp, Homo sapiens
atgaccgtcgcgcggccgagcgtgcccgcggcgctgcccctcctcggggagctgccccggctgctgctgctggtgctgttgtgcctgccggccgtgtggggtgactgtggccttcccccagatgtacctaatgcccagccagctttggaaggccgtacaagttttcccgaggatactgtaataacgtacaaatgtgaagaaagctttgtgaaaattcctggcgagaaggactcagtgatctgccttaagggcagtcaatggtcagatattgaagagttctgcaatcgtagctgcgaggtgccaacaaggctaaattctgcatccctcaaacagccttatatcactcagaattattttccagtcggtactgttgtggaatatgagtgccgtccaggttacagaagagaaccttctctatcaccaaaactaacttgccttcagaatttaaaatggtccacagcagtcgaattttgtaaaaagaaatcatgccctaatccgggagaaatacgaaatggtcagattgatgtaccaggtggcatattatttggtgcaaccatctccttctcatgtaacacagggtacaaattatttggctcgacttctagtttttgtcttatttcaggcagctctgtccagtggagtgacccgttgccagagtgcagagaaatttattgtccagcaccaccacaaattgacaatggaataattcaaggggaacgtgaccattatggatatagacagtctgtaacgtatgcatgtaataaaggattcaccatgattggagagcactctatttattgtactgtgaataatgatgaaggagagtggagtggcccaccacctgaatgcagaggaaaatctctaacttccaaggtcccaccaacagttcagaaacctaccacagtaaatgttccaactacagaagtctcaccaacttctcagaaaaccaccacaaaaaccaccacaccaaatgctcaagcaacacggagtacacctgtttccaggacaaccaagcattttcatgaaacaaccccaaataaaggaagtggaaccacttcaggtactacccgtcttctatctgggcacacgtgtttcacgttgacaggtttgcttgggacgctagtaaccatgggcttgctgacttag

SEQ ID NO: 192 - DNA, 3937 bp, Homo sapiens
ctaagttagcgccgctctccgcctcggcagtgccagccgccagtggtcgcacttggagggtctcgccgccagtggaaggagccaccgcccccgcccgaccatggccgaggagctggtcttagagaggtgtgatctggagctggagaccaatggccgagaccaccacacggccgacctgtgccgggagaagctggtggtgcgacggggccagcccttctggctgaccctgcactttgagggccgcaactacgaggccagtgtagacagtctcaccttcagtgtcgtgaccggcccagcccctagccaggaggccgggaccaaggcccgttttccactaagagatgctgtggaggagggtgactggacagccaccgtggtggaccagcaagactgcaccctctcgctgcagctcaccaccccggccaacgcccccatcggcctgtatcgcctcagcctggaggcctccactggctaccagggatccagctttgtgctgggccacttcattttgctcttcaacgcctggtgcccagcggatgctgtgtacctggactcggaagaggagcggcaggagtatgtcctcacccagcagggctttatctaccagggctcggccaagttcatcaagaacataccttggaattttgggcagtttgaagatgggatcctagacatctgcctgatccttctagatgtcaaccccaagttcctgaagaacgccggccgtgactgctcccgccgcagcagccccgtctacgtgggccgggtggtgagtggcatggtcaactgcaacgatgaccagggtgtgctgctgggacgctgggacaacaactacggggacggcgtcagccccatgtcctggatcggcagcgtggacatcctgcggcgctggaagaaccacggctgccagcgcgtcaagtatggccagtgctgggtcttcgccgccgtggcctgcacagtgctgaggtgcctgggcatccctacccgcgtcgtgaccaactacaactcggcccatgaccagaacagcaaccttctcatcgagtacttccgcaatgagtttggggagatccagggtgacaagagcgagatgatctggaacttccactgctgggtggagtcgtggatgaccaggccggacctgcagccggggtacgagggctggcaggccctggacccaacgccccaggagaagagcgaagggacgtactgctgtggcccagttccagttcgtgccatcaaggagggcgacctgagcaccaagtacgatgcgccctttgtctttgcggaggtcaatgccgacgtggtagactggatccagcaggacgatgggtctgtgcacaaatccatcaaccgttccctgatcgttgggctgaagatcagcactaagagcgtgggccgagacgagcgggaggatatcacccacacctacaaatacccagaggggtcctcagaggagagggaggccttcacaagggcgaaccacctgaacaaactggccgagaaggaggagacagggatggccatgcggatccgtgtgggccagagcatgaacatgggcagtgactttgacgtctttgcccacatcaccaacaacaccgctgaggagtacgtctgccgcctcctgctctgtgcccgcaccgtcagctacaatgggatcttggggcccgagtgtggcaccaagtacctgctcaacctcaacctggagcctttctctgagaagagcgttcctctttgcatcctctatgagaaataccgtgactgccttacggagtccaacctcatcaaggtgcgggccctcctcgtggagccagttatcaacagctacctgctggctgagagggacctctacctggagaatccagaaatcaagatccggatccttggggagcccaagcagaaacgcaagctggtggctgaggtgtccctgcagaacccgctccctgtggccctggaaggctgcaccttcactgtggagggggccggcctgactgaggagcagaagacggtggagatcccagaccccgtggaggcaggggaggaagttaaggtgagaatggacctgctgccgctccacatgggcctccacaagctggtggtgaacttcgagagcgacaagctgaaggctgtgaagggcttccggaatgtcatcattggccccgcctaagggacccctgctcccagcctgctgagagcccccaccttgatcccaatccttatcccaagctagtgagcaaaatatgccccttcttgggccccagaccccagggcagggtgggcagcctatgggggctctcggaaatggaatgtgcccctggcccatctcagcctcctgagcctgtgggtccccactcaccccctttgctgtgaggaatgctctgtgccagaaacagtgggagccctgaccttggctgactggggctggggtgagagaggaaagacctacattccctctcctgcccagatgccctttggaaagccattgaccacccaccatattgtttgatctacttcatagctccttggagcaggcaaaaaagggacagcatgccccttggctggatcagggaatccagctccctagactgcatcccgtacctcttcccatgactgcacccagctccaggggcccttgggacagccagagctgggtggggacagtgataggcccaaggtcccctccacatcccagcagcccaagcttaatagccctccccctcaacctcaccattgtgaagcacctactatgtgctgggtgcctcccacacttgctggggctcacggggcctccaacccatttaatcaccatgggaaactgttgtgggcgctgcttccaggataaggagactgaggcttagagagaggaggcagccccctccacaccagtggcctcgtggttattagcaaggctgggtaatgtgaaggcccaagagcagagtctgggcctctgactctgagtccactgctccatttataaccccagcctgacctgagactgtcggagaggctgtctggggcctttatcaaaaaaagactcagccaagacaaggaggtagagaggggactgggggactgggagtcagagccctggctgggttcaggtcccacgtctggccaggcactgccttctcctctctgggcctttgtttccttgttggtcagaggagtgattgaaccagctcatctccaaggatcctctccactccatgtttgcaatgcttttatatggcccagccttgtaaataaccacaaggtccactccctgctccacgaagccttaagccataggcccaggatatttctgagagtgaaaccatgactgtgaccaccttctgtccccagccctgtcctggttccttcctatgcccaggtaccacccttcagaccccagttctaggggagaagagccctggacacccctgctctacccatgagcctgcccgctgcaatgcctagacttcccaacagccttagctgccagtgctggtcactaaccaacaaggttggcaccccagctaccccttctttgcagggctaaggcccccaaacatagcccctgccccggaggaagcttggggaacccatgagttgtcagctttgactttatctcctgctctttctacatgactgggcctcccttgggctggaagaattggggattctctattggaggtgagatcacagcctccagggccccccaaatcccagggaaggacttggagagaatcatgctgttgcatttagaactttctgctttgcacaggaaagagtcacacaattaatcaacatgtatattttctctatacatagagctctatttctctacggttttataaaagccttgggttccaaccaggcagtagatgtgcttctgaaccgcaaggagcaaacactgaaataaaatagtttatttttcacactcaaaaaaaaaaaaaaaaaa

SEQ ID NO: 193 - DNA, 5630 bp, Homo sapiens
gcgcgaccgtcccgggggtggggccgggcgcagcggcgagaggaggcgaaggtggctgcggtagcagcagcgcggcagcctcggacccagcccggagcgcagggcggccgctgcaggtccccgctcccctccccgtgcgtccgcccatggccgccgccgggcagctgtgcttgctctacctgtcggcggggctcctgtcccggctcggcgcagccttcaacttggacactcgggaggacaacgtgatccggaaatatggagaccccgggagcctcttcggcttctcgctggccatgcactggcaactgcagcccgaggacaagcggctgttgctcgtgggggccccgcgcggagaagcgcttccactgcagagagccaacagaacgggagggctgtacagctgcgacatcaccgcccgggggccatgcacgcggatcgagtttgataacgatgctgaccccacgtcagaaagcaaggaagatcagtggatgggggtcaccgtccagagccaaggtccagggggcaaggtcgtgacatgtgctcaccgatatgaaaaaaggcagcatgttaatacgaagcaggaatcccgagacatctttgggcggtgttatgtcctgagtcagaatctcaggattgaagacgatatggatgggggagattggagcttttgtgatgggcgattgagaggccatgagaaatttggctcttgccagcaaggtgtagcagctacttttactaaagactttcattacattgtatttggagccccgggtacttataactggaaagggattgttcgtgtagagcaaaagaataacactttttttgacatgaacatctttgaagatgggccttatgaagttggtggagagactgagcatgatgaaagtctcgttcctgttcctgctaacagttacttaggtttttctttggactcagggaaaggtattgtttctaaagatgagatcacttttgtatctggtgctcccagagccaatcacagtggagccgtggttttgctgaagagagacatgaagtctgcacatctcctccctgagcacatattcgatggagaaggtctggcctcttcatttggctatgatgtggcggtggtggacctcaacaaggatgggtggcaagatatagttattggagccccacagtattttgatagagatggagaagttggaggtgcagtgtatgtctacatgaaccagcaaggcagatggaataatgtgaagccaattcgtcttaatggaaccaaagattctatgtttggcattgcagtaaaaaatattggagatattaatcaagatggctacccagatattgcagttggagctccgtatgatgacttgggaaaggtttttatctatcatggatctgcaaatggaataaataccaaaccaacacaggttctcaagggtatatcaccttattttggatattcaattgctggaaacatggaccttgatcgaaattcctaccctgatgttgctgttggttccctctcagattcagtaactattttcagatcccggcctgtgattaatattcagaaaaccatcacagtaactcctaacagaattgacctccgccagaaaacagcgtgtggggcgcctagtgggatatgcctccaggttaaatcctgttttgaatatactgctaaccccgctggttataatccttcaatatcaattgtgggcacacttgaagctgaaaaagaaagaagaaaatctgggctatcctcaagagttcagtttcgaaaccaaggttctgagcccaaatatactcaagaactaactctgaagaggcagaaacagaaagtgtgcatggaggaaaccctgtggctacaggataatatcagagataaactgcgtcccattcccataactgcctcagtggagatccaagagccaagctctcgtaggcgagtgaattcacttccagaagttcttccaattctgaattcagatgaacccaagacagctcatattgatgttcacttcttaaaagagggatgtggagacgacaatgtatgtaacagcaaccttaaactagaatataaattttgcacccgagaaggaaatcaagacaaattttcttatttaccaattcaaaaaggtgtaccagaactagttctaaaagatcagaaggatattgctttagaaataacagtgacaaacagcccttccaacccaaggaatcccacaaaagatggcgatgacgcccatgaggctaaactgattgcaacgtttccagacactttaacctattctgcatatagagaactgagggctttccctgagaaacagttgagttgtgttgccaaccagaatggctcgcaagctgactgtgagctcggaaatccttttaaaagaaattcaaatgtcactttttatttggttttaagtacaactgaagtcacctttgacaccccatatctggatattaatctgaagttagaaacaacaagcaatcaagataatttggctccaattacagctaaagcaaaagtggttattgaactgcttttatcggtctcgggagttgctaaaccttcccaggtgtattttggaggtacagttgttggcgagcaagctatgaaatctgaagatgaagtgggaagtttaatagagtatgaattcagggtaataaacttaggtaaacctcttacaaacctcggcacagcaaccttgaacattcagtggccaaaagaaattagcaatgggaaatggttgctttatttggtgaaagtagaatccaaaggattggaaaaggtaacttgtgagccacaaaaggagataaactccctgaacctaacggagtctcacaactcaagaaagaaacgggaaattactgaaaaacagatagatgataacagaaaattttctttatttgctgaaagaaaataccagactcttaactgtagcgtgaacgtgaactgtgtgaacatcagatgcccgctgcgggggctggacagcaaggcgtctcttattttgcgctcgaggttatggaacagcacatttctagaggaatattccaaactgaactacttggacattctcatgcgagccttcattgatgtgactgctgctgccgaaaatatcaggctgccaaatgcaggcactcaggttcgagtgactgtgtttccctcaaagactgtagctcagtattcgggagtaccttggtggatcatcctagtggctattctcgctgggatcttgatgcttgctttattagtgtttatactatggaagtgtggtttcttcaagagaaataagaaagatcattatgatgccacatatcacaaggctgagatccatgctcagccatctgataaagagaggcttacttctgatgcatagtattgatctacttctgtaattgtgtggattctttaaacgctctaggtacgatgacagtgttccccgataccatgctgtaaggatccggaaagaagagcgagagatcaaagatgaaaagtatattgataaccttgaaaaaaaacagtggatcacaaagtggaacagaaatgaaagctactcatagcgggggcctaaaaaaaaaaaagcttcacagtacccaaactgctttttccaactcagaaattcaatttggatttaaaagcctgctcaatccctgaggactgatttcagagtgactacacacagtacgaacctacagttttaactgtggatattgttacgtagcctaaggctcctgttttgcacagccaaatttaaaactgttggaatggatttttctttaactgccgtaatttaactttctgggttgcctttgtttttggcgtggctgacttacatcatgtgttggggaagggcctgcccagttgcactcaggtgacatcctccagatagtgtagctgaggaggcacctacactcacctgcactaacagagtggccgtcctaacctcgggcctgctgcgcagacgtccatcacgttagctgtcccacatcacaagactatgccattggggtagttgtgtttcaacggaaagtgctgtcttaaactaaatgtgcaatagaaggtgatgttgccatcctaccgtcttttcctgtttcctagctgtgtgaatacctgctcacgtcaaatgcatacaagtttcattctccctttcactaaaaacacacaggtgcaacagacttgaatgctagttatacttatttgtatatggtatttattttttcttttctttacaaaccattttgttattgactaacaggccaaagagtctccagtttacccttcaggttggtttaatcaatcagaattagaattagagcatgggagggtcatcactatgacctaaattatttactgcaaaaagaaaatctttataaatgtaccagagagagttgttttaataacttatctataaactataacctctccttcatgacagcctccaccccacaacccaaaaggtttaagaaatagaattataactgtaaagatgtttatttcaggcattggatattttttactttagaagcctgcataatgtttctggatttacatactgtaacattcaggaattcttggagaagatgggtttattcactgaactctagtgcggtttactcactgctgcaaatactgtatattcaggacttgaaagaaatggtgaatgcctatggaactagtggatccaaactgatccagtataagactactgaatctgctaccaaaacagttaatcagtgagtcgagtgttctattttttgttttgtttcctcccctatctgtattcccaaaaattactttggggctaatttaacaagaactttaaattgtgttttaattgtaaaaatggcagggggtggaattattactctatacattcaacagagactgaatagatatgaaagctgattttttttaattaccatgcttcacaatgttaagttatatggggagcaacagcaaacaggtgctaatttgttttggatatagtataagcagtgtctgtgttttgaaagaatagaacacagtttgtagtgccactgttgttttggggggggctttttttctttttccggaaaatccttaaaccttaagatactaaggacgttgttttggttgtacttggaattcttagtcacaaaatatattttgtttacaaaaatttctgtaaaacaggttataacagtgtttaaagtctcagtttcttgcttggggaacttgtgtccctaatgtgttagattgctagattgctaaggagctgatacttgacagttttttagacctgtgttactaaaaaaaagatgaatgtcggaaaagggtgttgggagggtggtcaacaaagaaacaaagatgttatggtgtttagacttatggttgttaaaaatgtcatctcaagtcaagtcactggtctgtttgcatttgatacatttttgtactaactagcattgtaaaattatttcatgattagaaattacctgtggatatttgtataaaagtgtgaaataaattttttataaaagtgttcattgtttcgtaacacagcattgtatatgtgaagcaaactctaaaattataaatgacaacctgaattatctatttcatcaaaaaaaaaaaaaaaaaaaagaaagggattgttcgtgta

SEQ ID NO: 194 - DNA, 4543 bp, Homo sapiens
cggcgggcggcgcgcacactgctcgctgggccgcggctcccgggtgtcccaggcccggccggtgcgcagagcatggcgggtgcgggcccgaagcggcgcgcgctagcggcgccggcggccgaggagaaggaagaggcgcgggagaagatgctggccgccaagagcgcggacggctcggcgccggcaggcgagggcgagggcgtgaccctgcagcggaacatcacgctgctcaacggcgtggccatcatcgtggggaccattatcggctcgggcatcttcgtgacgcccacgggcgtgctcaaggaggcaggctcgccggggctggcgctggtggtgtgggccgcgtgcggcgtcttctccatcgtgggcgcgctctgctacgcggagctcggcaccaccatctccaaatcgggcggcgactacgcctacatgctggaggtctacggctcgctgcccgccttcctcaagctctggatcgagctgctcatcatccggccttcatcgcagtacatcgtggccctggtcttcgccacctacctgctcaagccgctcttccccacctgcccggtgcccgaggaggcagccaagctcgtggcctgcctctgcgtgctgctgctcacggccgtgaactgctacagcgtgaaggccgccacccgggtccaggatgcctttgccgccgccaagctcctggccctggccctgatcatcctgctgggcttcgtccagatcgggaagggtgatgtgtccaatctagatcccaacttctcatttgaaggcaccaaactggatgtggggaacattgtgctggcattatacagcggcctctttgcctatggaggatggaattacttgaatttcgtcacagaggaaatgatcaacccctacagaaacctgcccctggccatcatcatctccctgcccatcgtgacgctggtgtacgtgctgaccaacctggcctacttcaccaccctgtccaccgagcagatgctgtcgtccgaggccgtggccgtggacttcgggaactatcacctgggcgtcatgtcctggatcatccccgtcttcgtgggcctgtcctgcttcggctccgtcaatgggtccctgttcacatcctccaggctcttcttcgtggggtcccgggaaggccacctgccctccatcctctccatgatccacccacagctcctcacccccgtgccgtccctcgtgttcacgtgtgtgatgacgctgctctacgccttctccaaggacatcttctccgtcatcaacttcttcagcttcttcaactggctctgcgtggccctggccatcatcggcatgatctggctgcgccacagaaagcctgagcttgagcggcccatcaaggtgaacctggccctgcctgtgttcttcatcctggcctgcctcttcctgatcgccgtctccttctggaagacacccgtggagtgtggcatcggcttcaccatcatcctcagcgggctgcccgtctacttcttcggggtctggtggaaaaacaagcccaagtggctcctccagggcatcttctccacgaccgtcctgtgtcagaagctcatgcaggtggtcccccaggagacatagccaggaggccgagtggctgccggaggagcatgcgcagaggccagttaaagtagatcacctcctcgaacccactccggttccccgcaacccacagctcagctgcccatcccagtccctcgccgtccctcccaggtcgggcagtggaggctgctgtgaaaactctggtacgaatctcatccctcaactgagggccagggacccaggtgtgcctgtgctcctgcccaggagcagcttttggtctccttgggccctttttcccttccctcctttgtttacttatatatatattttttttaaacttaaattttgggtcaacttgacaccactaagatgattttttaaggagctgggggaaggcaggagccttcctttctcctgccccaagggcccagaccctgggcaaacagagctactgagacttggaacctcattgctaccacagacttgcactgaagccggacagctgcccagacacatgggcttgtgacattcgtgaaaaccaaccctgtgggcttatgtctctgccttagggtttgcagagtggaaactcagccgtagggtggcactgggagggggtgggggatctgggcaaggtgggtgattcctcccaggaggtgcttgaggccccgatggactcctgaccataatcctagccccgagacaccatcctgagccagggaacagccccagggttggggggtgccggcatctcccctagctcaccaggcctggcctctgggcagtgtggcctcttggctatttctgtgtccagttttggaggctgagttctggttcatgcagacaaagccctgtccttcagtcttctagaaacagagacaagaaaggcagacacaccgcggccaggcacccatgtgggcgcccaccctgggctccacacagcagtgtcccctgccccagaggtcgcagctaccctcagcctccaatgcattggcctctgtaccgcccggcagccccttctggccggtgctgggttcccactcccggcctaggcacctccccgctctccctgtcacgctcatgtcctgtcctggtcctgatgcccgttgtctaggagacagagccaagcactgctcacgtctctgccgcctgcgtttggaggcccctgggctctcacccagtccccacccgcctgcagagagggaactagggcaccccttgtttctgttgttcccgtgaatttttttcgctatgggaggcagccgaggcctggccaatgcggcccactttcctgagctgtcgctgcctccatggcagcagccagggacccccagaacaagaagaccccgcaggatccctcctgagctcggggggctctgccttctcaggccccgggcttcccttctccccagccagaggtggagccaagtggtccagcgtcactccagtgctcagctgtggctggaggagctggcctgtggcacagccctgagtgtcccaagccgggagccaacgaagccggacacggcttcactgaccagcggctgctcaagccgcaagctctcagcaagtgcccagtggagcctgccgcccccgcctgggcaccgggaccccctcaccatccagtgggcccggagaaacctgatgaacagtttggggactcaggaccagatgtccgtctctcttgcttgaggaatgaagacctttattcacccctgccccgttgcttcccgctgcacatggacagacttcacagcgtctgctcataggacctgcatccttcctggggacgaattccactcgtccaagggacagcccacggtctggaggccgaggaccaccagcaggcaggtggactgactgtgttgggcaagacctcttccctctgggcctgttctcttggctgcaaataaggacagcagctggtgccccacctgcctggtgcattgctgtgtgaatccaggaggcagtggacatcgtaggcagccacggccccgggtccaggagaagtgctccctggaggcacgcaccactgcttcccactggggccggcggggcccacgcacgacgtcagcctcttaccttcccgcctcggctaggggtcctcgggatgccgttctgttccaacctcctgctctgggacgtggacatgcctcaaggatacagggagccggcggcctctcgacggcacgcacttgcctgttggctgctgcggctgtgggcgagcatgggggctgccagcgtctgttgtggaaagtagctgctagtgaaatggctggggccgctggggtccgtcttcacactgcgcaggtctcttctgggcgtctgagctggggtgggagctcctccgcagaaggttggtggggggtccagtctgtgatccttggtgctgtgtgccccactccagcctggggaccccacttcagaaggtaggggccgtgtcccgcggtgctgactgaggcctgcttccccctccccctcctgctgtgctggaattccacagggaccagggccaccgcaggggactgtctcagaagacttgatttttccgtccctttttctccacactccactgacaaacgtccccagcggtttccacttgtgggcttcaggtgttttcaagcacaacccaccacaacaagcaagtgcattttcagtcgttgtgcttttttgttttgtgctaacgtcttactaatttaaagatgctgtcggcaccatgtttatttatttccagtggtcatgctcagccttgctgctctgcgtggcgcaggtgccatgcctgctccctgtctgtgtcccagccacgcagggccatccactgtgacgtcggccgaccaggctggacaccctctgccgagtaatgacgtgtgtggctgggaccttctttattctgtgttaatggctaacctgttacactgggctgggttgggtagggtgttctggcttttttgtggggtttttatttttaaagaaacactcaatcatccta

SEQ ID NO: 195 - DNA, 5925 bp, Homo sapiens
gcgctgcccgcctcgtccccacccccccaacccccgcgcccgccctcggacagtccctgctcgcccgcgcgctgcagccccatctcctagcggcagcccaggcgcggagggagcgagtccgccccgaggtaggtccaggacgggcgcacagcagcagccgaggctggccgggagagggaggaagaggatggcagggccacgccccagcccatgggccaggctgctcctggcagccttgatcagcgtcagcctctctgggaccttggcaaaccgctgcaagaaggccccagtgaagagctgcacggagtgtgtccgtgtggataaggactgcgcctactgcacagacgagatgttcagggaccggcgctgcaacacccaggcggagctgctggccgcgggctgccagcgggagagcatcgtggtcatggagagcagcttccaaatcacagaggagacccagattgacaccaccctgcggcgcagccagatgtccccccaaggcctgcgggtccgtctgcggcccggtgaggagcggcattttgagctggaggtgtttgagccactggagagccccgtggacctgtacatcctcatggacttctccaactccatgtccgatgatctggacaacctcaagaagatggggcagaacctggctcgggtcctgagccagctcaccagcgactacactattggatttggcaagtttgtggacaaagtcagcgtcccgcagacggacatgaggcctgagaagctgaaggagccctggcccaacagtgacccccccttctccttcaagaacgtcatcagcctgacagaagatgtggatgagttccggaataaactgcagggagagcggatctcaggcaacctggatgctcctgagggcggcttcgatgccatcctgcagacagctgtgtgcacgagggacattggctggcgcccggacagcacccacctgctggtcttctccaccgagtcagccttccactatgaggctgatggcgccaacgtgctggctggcatcatgagccgcaacgatgaacggtgccacctggacaccacgggcacctacacccagtacaggacacaggactacccgtcggtgcccaccctggtgcgcctgctcgccaagcacaacatcatccccatctttgctgtcaccaactactcctatagctactacgagaagcttcacacctatttccctgtctcctcactgggggtgctgcaggaggactcgtccaacatcgtggagctgctggaggaggccttcaatcggatccgctccaacctggacatccgggccctagacagcccccgaggccttcggacagaggtcacctccaagatgttccagaagacgaggactgggtcctttcacatccggcggggggaagtgggtatataccaggtgcagctgcgggcccttgagcacgtggatgggacgcacgtgtgccagctgccggaggaccagaagggcaacatccatctgaaaccttccttctccgacggcctcaagatggacgcgggcatcatctgtgatgtgtgcacctgcgagctgcaaaaagaggtgcggtcagctcgctgcagcttcaacggagacttcgtgtgcggacagtgtgtgtgcagcgagggctggagtggccagacctgcaactgctccaccggctctctgagtgacattcagccctgcctgcgggagggcgaggacaagccgtgctccggccgtggggagtgccagtgcgggcactgtgtgtgctacggcgaaggccgctacgagggtcagttctgcgagtatgacaacttccagtgtccccgcacttccgggttcctctgcaatgaccgaggacgctgctccatgggccagtgtgtgtgtgagcctggttggacaggcccaagctgtgactgtcccctcagcaatgccacctgcatcgacagcaatgggggcatctgtaatggacgtggccactgtgagtgtggccgctgccactgccaccagcagtcgctctacacggacaccatctgcgagatcaactactcggcgatccacccgggcctctgcgaggacctacgctcctgcgtgcagtgccaggcgtggggcaccggcgagaagaaggggcgcacgtgtgaggaatgcaacttcaaggtcaagatggtggacgagcttaagagagccgaggaggtggtggtgcgctgctccttccgggacgaggatgacgactgcacctacagctacaccatggaaggtgacggcgcccctgggcccaacagcactgtcctggtgcacaagaagaaggactgccctccgggctccttctggtggctcatccccctgctcctcctcctcctgccgctcctggccctgctactgctgctatgctggaagtactgtgcctgctgcaaggcctgcctggcacttctcccgtgctgcaaccgaggtcacatggtgggctttaaggaagaccactacatgctgcgggagaacctgatggcctctgaccacttggacacgcccatgctgcgcagcgggaacctcaagggccgtgacgtggtccgctggaaggtcaccaacaacatgcagcggcctggctttgccactcatgccgccagcatcaaccccacagagctggtgccctacgggctgtccttgcgcctggcccgcctttgcaccgagaacctgctgaagcctgacactcgggagtgcgcccagctgcgccaggaggtggaggagaacctgaacgaggtctacaggcagatctccggtgtacacaagctccagcagaccaagttccggcagcagcccaatgccgggaaaaagcaagaccacaccattgtggacacagtgctgatggcgccccgctcggccaagccggccctgctgaagcttacagagaagcaggtggaacagagggccttccacgacctcaaggtggcccccggctactacaccctcactgcagaccaggacgcccggggcatggtggagttccaggagggcgtggagctggtggacgtacgggtgcccctctttatccggcctgaggatgacgacgagaagcagctgctggtggaggccatcgacgtgcccgcaggcactgccaccctcggccgccgcctggtaaacatcaccatcatcaaggagcaagccagagacgtggtgtcctttgagcagcctgagttctcggtcagccgcggggaccaggtggcccgcatccctgtcatccggcgtgtcctggacggcgggaagtcccaggtctcctaccgcacacaggatggcaccgcgcagggcaaccgggactacatccccgtggagggtgagctgctgttccagcctggggaggcctggaaagagctgcaggtgaagctcctggagctgcaagaagttgactccctcctgcggggccgccaggtccgccgtttccacgtccagctcagcaaccctaagtttggggcccacctgggccagccccactccaccaccatcatcatcagggacccagatgaactggaccggagcttcacgagtcagatgttgtcatcacagccaccccctcacggcgacctgggcgccccgcagaaccccaatgctaaggccgctgggtccaggaagatccatttcaactggctgcccccttctggcaagccaatggggtacagggtaaagtactggattcagggtgactccgaatccgaagcccacctgctcgacagcaaggtgccctcagtggagctcaccaacctgtacccgtattgcgactatgagatgaaggtgtgcgcctacggggctcagggcgagggaccctacagctccctggtgtcctgccgcacccaccaggaagtgcccagcgagccagggcgtctggccttcaatgtcgtctcctccacggtgacccagctgagctgggctgagccggctgagaccaacggtgagatcacagcctacgaggtctgctatggcctggtcaacgatgacaaccgacctattgggcccatgaagaaagtgctggttgacaaccctaagaaccggatgctgcttattgagaaccttcgggagtcccagccctaccgctacacggtgaaggcgcgcaacggggccggctgggggcctgagcgggaggccatcatcaacctggccacccagcccaagaggcccatgtccatccccatcatccctgacatccctatcgtggacgcccagagcggggaggactacgacagcttccttatgtacagcgatgacgttctacgctctccatcgggcagccagaggcccagcgtctccgatgacactggctgcggctggaagttcgagcccctgctgggggaggagctggacctgcggcgcgtcacgtggcggctgcccccggagctcatcccgcgcctgtcggccagcagcgggcgctcctccgacgccgaggcgccccacgggcccccggacgacggcggcgcgggcgggaagggcggcagcctgccccgcagtgcgacacccgggccccccggagagcacctggtgaatggccggatggactttgccttcccgggcagcaccaactccctgcacaggatgaccacgaccagtgctgctgcctatggcacccacctgagcccacacgtgccccaccgcgtgctaagcacatcctccaccctcacacgggactacaactcactgacccgctcagaacactcacactcgaccacactgcccagggactactccaccctcacctccgtctcctcccacgactctcgcctgactgctggtgtgcccgacacgcccacccgcctggtgttctctgccctggggcccacatctctcagagtgagctggcaggagccgcggtgcgagcggccgctgcagggctacagtgtggagtaccagctgctgaacggcggtgagctgcatcggctcaacatccccaaccctgcccagacctcggtggtggtggaagacctcctgcccaaccactcctacgtgttccgcgtgcgggcccagagccaggaaggctggggccgagagcgtgagggtgtcatcaccattgaatcccaggtgcacccgcagagcccactgtgtcccctgccaggctccgccttcactttgagcactcccagtgccccaggcccgctggtgttcactgccctgagcccagactcgctgcagctgagctgggagcggccacggaggcccaatggggatatcgtcggctacctggtgacctgtgagatggcccaaggaggagggccagccaccgcattccgggtggatggagacagccccgagagccggctgaccgtgccgggcctcagcgagaacgtgccctacaagttcaaggtgcaggccaggaccactgagggcttcgggccagagcgcgagggcatcatcaccatagagtcccaggatggaggacccttcccgcagctgggcagccgtgccgggctcttccagcacccgctgcaaagcgagtacagcagcatcaccaccacccacaccagcgccaccgagcccttcctagtggatgggctgaccctgggggcccagcacctggaggcaggcggctccctcacccggcatgtgacccaggagtttgtgagccggacactgaccaccagcggaacccttagcacccacatggaccaacagttcttccaaacttgaccgcaccctgccccacccccgccacgtcccactaggcgtcctcccgactcctctcccggagcctcctcagctactccatccttgcacccctgggggcccagcccacccgcatgcacagagcaggggctaggtgtctcctgggaggcatgaagggggcaaggtccgtcctctgtgggcccaaacctatttgtaaccaaagagctgggagcagcacaaggacccagcctttgttctgcacttaataaatggttttgctactgctaaaaaaa

SEQ ID NO: 196 - DNA, 1738 bp, Homo sapiens
cgggggggtactgtgcgagccctcaaggaggtggctgttctgtagctggagagctccgtgggtggcaggactgaacttgaacaccagaaacaacccccaagccttgtgacctgggaggcaggaggcgggtctgtctccctgggacttgggtggctgagccgaggtactcgggaccctgtcccgcgcatggcagagtggctcctcacagcctgaagctcatccttctgcacgggccagccaggccagcacagaggcaccagggcagcagtgcacacaggtccccggggaccccaccatgtggagcggatggtggctgtggccccttgtggccgtctgcactgcagacttctttcgggacgaggcagagaggatcatgagggactcccctgtcattgatgggcacaatgacctcccctggcagctgctggatatgttcaacaaccggctgcaggacgagagggccaacctgaccaccttggccggcacacacaccaacatccccaagctgagggccggctttgtgggaggccagttctggtccgtgtacacgccctgcgacacccagaacaaagacgccgtgcggaggacgctggagcagatggacgtggtccaccgcatgtgccggatgtacccggagaccttcctgtatgtcaccagcagtgcaggcattcggcaggccttccgggaagggaaggtggccagcctgatcggcgtggagggcggccactccattgacagcagtttgggcgtcctgcgggcactctatcagctgggcatgcggtacctgaccctcacccacagctgcaacacgccctgggctgacaactggctggtggacacgggagacagcgagccccagagccaaggcttgtcaccctttgggcagcgtgtggtgaaggagctgaaccgtctgggggtcctcatcgacttggctcacgtgtctgtggccaccatgaaggccaccctgcagctgtccagagccccggtcatcttcagccactcctcggcctacagcgtgtgcgcaagccggcgcaacgtgcctgacgacgtcctgaggctggtgaaacagacagacagcctggtgatggtgaacttctacaacaattacatttcctgcaccaacaaggccaacctgtcccaagtggccgaccatctggatcacatcaaggaggtggcaggagccagagccgtgggttttggtggggactttgatggtgttccaagggtccctgaggggctggaggacgtctccaagtatccagacctgatcgctgagctgctcaggaggaactggacggaggcggaggtcaagggcgcactggctgacaacctgctgagggtcttcgaggctgtggaacaggccagcaacctcacacaggctcccgaggaggagcccatcccgctggaccagctgggtggctcctgcaggacccattacggctactcctctggggcttccagcctccatcgccactgggggctcctgctggcctccctcgctcccctggtcctctgtctgtctctcctgtgaaacctgggagaccagagtcccctttagggttcccggagctccgggaagacccgcccatcccaggactccagatgccaggagccctgctgcccacatgcaaggaccagcatctcctgagaggacgcctgggcttacctggggggcaggatgcctggggacagttcaggacacacacacagtaggcccgcaataaaagcaacacccctt

SEQ ID NO: 197 - DNA, 2153 bp, Homo sapiens; identical to SEQ ID NO: 123

SEQ ID NO: 198 - DNA, 1810 bp, Homo sapiens
ggcgcggcgcggcgcagtcggctcgagtactccccgtaacgaggaggtgttctcggccgtcccacccttcactgccgtctccgggctgcgccgccggagccgggacgcgcctccgcagccctcgccgcctccatccccgcggccgcagctcctctcgccgtccgcgcgcacaccatgacgaagaacgagaagaagtccctcaaccagagcctggccgagtggaagctcttcatctacaacccgaccaccggagaattcctggggcgcaccgccaagagctggggtttgatcttgctcttctacctagttttttatgggttcctggctgcactcttctcattcacgatgtgggttatgcttcagactctcaacgatgaggttccaaaataccgtgaccagattcctagcccaggactcatggtttttccaaaaccagtgaccgcattggaatatacattcagtaggtctgatccaacttcgtatgcagggtacattgaagaccttaagaagtttctaaaaccatatactttagaagaacagaagaacctcacagtctgtcctgatggagcactttttgaacagaagggtccagtttatgttgcatgtcagtttcctatttcattacttcaagcatgcagtggtatgaatgatcctgattttggctattctcaaggaaacccttgtattcttgtgaaaatgaacagaataattggattaaagcctgaaggagtgccaaggatagattgtgtttcaaagaatgaagatataccaaatgtagcagtttatcctcataatggaatgatagacttaaaatatttcccatattatgggaaaaaactgcatgttgggtatctacagccattggttgctgttcaggtcagctttgctcctaacaacactgggaaagaagtaacagttgagtgcaagattgatggatcagccaacctaaaaagtcaggatgatcgtgacaagtttttgggacgagttatgttcaaaatcacagcacgtgcatagtatgagtaggatatctccacagagtaaatgttgtgttgtctgtcttcattttgtaacagctggaccttccattctagaattatgagaccaccttggagaaaggtgtgtggtacatgacattgggttacatcataacgtgcttccagatcatagtgttcagtgtcctctgaagtaactgcctgttgcctctgctgccctttgaaccagtgtacagtcgccagatagggaccggtgaacacctgattccaaacatgtaggatgggggtcttgtcctctttttatgtggtttaattgccaagtgtctaaagcttaatatgccgtgctatgtaaatattttatggatataacaactgtcatattttgatgtcaacagagttttagggataaaatggtacccggccaacatcaagtgactttatagctgcaagaaatgtggtatgtggagaagttctgtatgtgaggaaggaaaaaaagaaaataaaagtgtgtttgaaaaatattatcttgggttctttgtaaaatttattttttacatgctgaattagcctcgatctttttgattaagagcacaaacttttttttgtaaaacatgtaaaaaaaaaaactgggattaatttttagtgttggaactgcctcttattttaggctgtagataaaatagcatttttaggttagccagtgtgactatgcacctaattttttatgagattaaattcataagacttaatttgtacaatagtttgtgaaatatcttgttactgcttttatttagcagactgtggactgtaataaagta

SEQ ID NO: 199 - DNA, 2771 bp, Homo sapiens
ggccacaggccagcgccactctgccaggctcccggccatcgcccgcctggtgcgccgcccgccagctctttgcccgcgcggggccgcccgccgcgggctcagggcagaccatgcgcccgccaagtccgctgcccgcccgctggctatgcgtgctggcaggcgccctcgcctgggcccttgggccggcgggcggccaggcggccaggctgcaggaggagtgtgactatgtgcagatgatcgaggtgcagcacaagcagtgcctggaggaggcccagctggagaatgagacaataggctgcagcaagatgtgggacaacctcacctgctggccagccacccctcggggccaggtagttgtcttggcctgtcccctcatcttcaagctcttctcctccattcaaggccgcaatgtaagccgcagctgcaccgacgaaggctggacgcacctggagcctggcccgtaccccattgcctgtggtttggatgacaaggcagcgagtttggatgagcagcagaccatgttctacggttctgtgaagaccggctacaccattggctacggcctgtccctcgccacccttctggtcgccacagctatcctgagcctgttcaggaagctccactgcacgcggaactacatccacatgcacctcttcatatccttcatcctgagggctgccgctgtcttcatcaaagacttggccctcttcgacagcggggagtcggaccagtgctccgagggctcggtgggctgtaaggcagccatggtctttttccaatattgtgtcatggctaacttcttctggctgctggtggagggcctctacctgtacaccctgcttgccgtctccttcttctctgagcggaagtacttctgggggtacatactcatcggctggggggtacccagcacattcaccatggtgtggaccatcgccaggatccattttgaggattatgggtgctgggacaccatcaactcctcactgtggtggatcataaagggccccatcctcacctccatcttggtaaacttcatcctgtttatttgcatcatccgaatcctgcttcagaaactgcggcccccagatatcaggaagagtgacagcagtccatactcaaggctagccaggtccacactcctgctgatccccctgtttggagtacactacatcatgttcgccttctttccggacaattttaagcctgaagtgaagatggtctttgagctcgtcgtggggtctttccagggttttgtggtggctatcctctactgcttcctcaatggtgaggtgcaggcggagctgaggcggaagtggcggcgctggcacctgcagggcgtcctgggctggaaccccaaataccggcacccgtcgggaggcagcaacggcgccacgtgcagcacgcaggtttccatgctgacccgcgtcagcccaggtgcccgccgctcctccagcttccaagccgaagtctccctggtctgaccaccaggatcccaggggcccaaggcggcccctcccgccccttcccactcaccccggcagacgccggggacagaggcctgcccgggcgcggccagccccggccctgggctcggaggctgcccccggccccctggtctctggtccggacactcctagagaacgcagccctagagcctgcctggagcgtttctagcaagtgagagagatgggagctcctctcctggaggattgcaggtggaactcagtcattagactcctcctccaaaggccccctacgccaatcaagggcaaaaagtctacatactttcatcctgactctgccccctgctggctcttctgcccaattggaggaaagcaaccggtggatcctcaaacaacactggtgtgacctgagggcagaaaggttctgcccggggaaggtcaccagcaccaacaccacggtagtgcctgaaatttcaccattgctgtcaagttcctttgggttaagcattaccactcaggcatttgactgaagatgcagctcactaccctattctctctttacgcttagttatcagctttttaaagtgggttattctggagtttttgtttggagagcacacctatcttagtggttccccaccgaagtggactggcccctgggtcagtctggtgggaggacggtgcaacccaaggactgagggactctgaagcctctgggaaatgagaaggcagccaccagcgaatgctaggtctcggactaagcctacctgctctccaagtctcagtggcttcatctgtcaagtgggatctgtcacaccagccatacttatctctctgtgctgtggaagcaacaggaatcaagagctgccctccttgtccacccacctatgtgccaactgttgtaactaggctcagagatgtgcacccatgggctctgacagaaagcagatacctcaccctgctacacatacaggatttgaactcagatctgtctgataggaatgtgaaagcacggactcttactgctaacttttgtgtatcgtaaccagccagatcctcttggttatttgtttaccacttgtattattaatgccattatcctgaattccccttgccaccccaccctccctggcgtgtggctgaggaggcctccatctcatgtatcatctggataggagcctgctggtcacagcctcctctgtctgcccttcaccccagtggccactcagcttcctacccacacctctgccagaagatcccctcaggactgcaacaggcttgtgcaacaataaatgttggcttgga

SEQ ID NO: 200 - DNA, 3901 bp, Homo sapiens
ctttcactggcaagagacggagtcctgggtttcagttccagttgcctgcggtgggctgtgtgagtttgccaaagtcccctgccctctctgggtctcggttccctcgcctgtccacgtgaggttggaggagctgaacgccgacgtcatttttagctaagagggagcagggtccccgagtcgccggcccagggtctgcgcatccgaggccgcgcgccctttcccctcccccacggctcctccgggccccgcactctgcgccccggctgccgcccagcgccctacaccgccctcagggggccctcgcgggctccccccggccgggatgccagtgccccgcgccacgcgcgcctgctcccgcgccgcctgccctgcagcctgcccgcggcgcctttatacccagcgggctcggcgctcactaatgtttaactcggggccgaaacttgccagcggcgagtgactccaccgcccggagcagcggtgcaggacgcgcgtctccgccgcccgcggtgacttctgcctgcgctccttctctgaacgctcacttccgaggagacgccgacgatgaagacaccgtggaaggttcttctgggactgctgggtgctgctgcgcttgtcaccatcatcaccgtgcccgtggttctgctgaacaaaggcacagatgatgctacagctgacagtcgcaaaacttacactctaactgattacttaaaaaatacttatagactgaagttatactccttaagatggatttcagatcatgaatatctctacaaacaagaaaataatatcttggtattcaatgctgaatatggaaacagctcagttttcttggagaacagtacatttgatgagtttggacattctatcaatgattattcaatatctcctgatgggcagtttattctcttagaatacaactacgtgaagcaatggaggcattcctacacagcttcatatgacatttatgatttaaataaaaggcagctgattacagaagagaggattccaaacaacacacagtgggtcacatggtcaccagtgggtcataaattggcatatgtttggaacaatgacatttatgttaaaattgaaccaaatttaccaagttacagaatcacatggacggggaaagaagatataatatataatggaataactgactgggtttatgaagaggaagtcttcagtgcctactctgctctgtggtggtctccaaacggcacttttttagcatatgcccaatttaacgacacagaagtcccacttattgaatactccttctactctgatgagtcactgcagtacccaaagactgtacgggttccatatccaaaggcaggagctgtgaatccaactgtaaagttctttgttgtaaatacagactctctcagctcagtcaccaatgcaacttccatacaaatcactgctcctgcttctatgttgataggggatcactacttgtgtgatgtgacatgggcaacacaagaaagaatttctttgcagtggctcaggaggattcagaactattcggtcatggatatttgtgactatgatgaatccagtggaagatggaactgcttagtggcacggcaacacattgaaatgagtactactggctgggttggaagatttaggccttcagaacctcattttacccttgatggtaatagcttctacaagatcatcagcaatgaagaaggttacagacacatttgctatttccaaatagataaaaaagactgcacatttattacaaaaggcacctgggaagtcatcgggatagaagctctaaccagtgattatctatactacattagtaatgaatataaaggaatgccaggaggaaggaatctttataaaatccaacttagtgactatacaaaagtgacatgcctcagttgtgagctgaatccggaaaggtgtcagtactattctgtgtcattcagtaaagaggcgaagtattatcagctgagatgttccggtcctggtctgcccctctatactctacacagcagcgtgaatgataaagggctgagagtcctggaagacaattcagctttggataaaatgctgcagaatgtccagatgccctccaaaaaactggacttcattattttgaatgaaacaaaattttggtatcagatgatcttgcctcctcattttgataaatccaagaaatatcctctactattagatgtgtatgcaggcccatgtagtcaaaaagcagacactgtcttcagactgaactgggccacttaccttgcaagcacagaaaacattatagtagctagctttgatggcagaggaagtggttaccaaggagataagatcatgcatgcaatcaacagaagactgggaacatttgaagttgaagatcaaattgaagcagccagacaattttcaaaaatgggatttgtggacaacaaacgaattgcaatttggggctggtcatatggagggtacgtaacctcaatggtcctgggatcgggaagtggcgtgttcaagtgtggaatagccgtggcgcctgtatcccggtgggagtactatgactcagtgtacacagaacgttacatgggtctcccaactccagaagacaaccttgaccattacagaaattcaacagtcatgagcagagctgaaaattttaaacaagttgagtacctccttattcatggaacagcagatgataacgttcactttcagcagtcagctcagatctccaaagccctggtcgatgttggagtggatttccaggcaatgtggtatactgatgaagaccatggaatagctagcagcacagcacaccaacatatatatacccacatgagccacttcataaaacaatgtttctctttaccttagcacctcaaaataccatgccatttaaagcttattaaaactcatttttgttttcattatctcaaaactgcactgtcaagatgatgatgatctttaaaatacacactcaaatcaagaaacttaaggttacctttgttcccaaatttcatacctatcatcttaagtagggacttctgtcttcacaacagattattaccttacagaagtttgaattatccggtcgggttttattgtttaaaatcatttctgcatcagctgctgaaacaacaaataggaattgtttttatggaggctttgcatagattccctgagcaggattttaatctttttctaactggactggttcaaatgttgttctcttctttaaagggatggcaagatgtgggcagtgatgtcactagggcagggacaggataagagggattagggagagaagatagcagggcatggctgggaacccaagtccaagcataccaacacgagcaggctactgtcagctcccctcggagaagagctgttcacagccagactggcacagttttctgagaaagactattcaaacagtctcaggaaatcaaatatgcaaagcactgacttctaagtaaaaccacagcagttgaaaagactccaaagaaatgtaagggaaactgccagcaacgcaggcccccaggtgccagttatggctataggtgctacaaaaacacagcaagggtgatgggaaagcattgtaaatgtgcttttaaaaaaaaatactgatgttcctagtgaaagaggcagcttgaaactgagatgtgaacacatcagcttgccctgttaaaagatgaaaatatttgtatcacaaatcttaacttgaaggagtccttgcatcaatttttcttatttcatttctttgagtgtcttaattaaaagaatattttaacttccttggactcattttaaaaaatggaacataaaatacaatgttatgtattattattcccattctacatactatggaatttctcccagtcatttaataaatgtgccttcattttttcagaaa

SEQ ID NO: 201 - DNA, 2492 bp, Homo sapiens
gggtgcagaggtgccgccgccgccgcgagccagtcgggagcgcgcgaggcgcggggagcctgggaccaggagcgagagccgcctacctgcagccgccgcccacggcacggcagccaccatggcgctcctgctgtgcttcgtgctcctgtgcggagtagtggatttcgccagaagtttgagtatcactactcctgaagagatgattgaaaaagccaaaggggaaactgcctatctgccatgcaaatttacgcttagtcccgaagaccagggaccgctggacatcgagtggctgatatcaccagctgataatcagaaggtggatcaagtgattattttatattctggagacaaaatttatgatgactactatccagatctgaaaggccgagtacattttacgagtaatgatctcaaatctggtgatgcatcaataaatgtaacgaatttacaactgtcagatattggcacatatcagtgcaaagtgaaaaaagctcctggtgttgcaaataagaagattcatctggtagttcttgttaagccttcaggtgcgagatgttacgttgatggatctgaagaaattggaagtgactttaagataaaatgtgaaccaaaagaaggttcacttccattacagtatgagtggcaaaaattgtctgactcacagaaaatgcccacttcatggttagcagaaatgacttcatctgttatatctgtaaaaaatgcctcttctgagtactctgggacatacagctgtacagtcagaaacagagtgggctctgatcagtgcctgttgcgtctaaacgttgtccctccttcaaataaagctggactaattgcaggagccattataggaactttgcttgctctagcgctcattggtcttatcatcttttgctgtcgtaaaaagcgcagagaagaaaaatatgaaaaggaagttcatcacgatatcagggaagatgtgccacctccaaagagccgtacgtccactgccagaagctacatcggcagtaatcattcatccctggggtccatgtctccttccaacatggaaggatattccaagactcagtataaccaagtaccaagtgaagactttgaacgcactcctcagagtccgactctcccacctgctaaggtagctgcccctaatctaagtcgaatgggtgcgattcctgtgatgattccagcacagagcaaggatgggtctatagtatagagcctccatatgtctcatctgtgctctccgtgttcctttcctttttttgatatatgaaaacctattctggtctaaattgtgttactagcctcaaaatacatcaaaaaataagttaatcaggaactgtacggaatatatttttaaaaatttttgtttggttatatcgaaatagttacaggcactaaagttagtaaagaaaagtttaccatctgaaaaagctggattttctttaagaggttgattataaagttttctaaatttatcagtacctaagtaagatgtagcgctttgaatatgaaatcataggtgaagacatgggtgaacttacttgcataccaagttgatacttgaataaccatctgaaagtggtacttgatcatttttaccattatttttaggatgtgtatttcatttatttatggcccaccagtctcccccaaattagtacagaaatatccatgacaaaattacttacgtatgtttgtacttggttttacagctcctttgaaaactctgtgtttggaatatctctaaaaacatagaaaacactacagtggtttagaaattactaattttacttctaagtcattcataaaccttgtctatgaaatgacttcttaaatatttagttgatagactgctacaggtaatagggacttagcaagctcttttatatgctaaaggagcatctatcagattaagttagaacatttgctgtcagccacatattgagatgacactaggtgcaatagcagggatagattttgttggtgagtagtctcatgccttgagatctgtggtggtcttcaaaatggtggccagccagatcaaggatgtagtatctcatagttcccaggtgatatttttcttattagaaaaatattataactcatttgttgtttgacacttatagattgaaatttcctaatttattctaaattttaagtggttctttggttccagtgctttatgttgttgttgtttttggatggtgttacatattatatgttctagaaacatgtaatcctaaatttaccctcttgaatataatccctggatgatattttttatcataaatgcagaataatcaaatacattttaagcaagttaagtgtcctccatcaattctgtattccagacttgggaggatgtacagttgctgttgtgtgatcaaacatgtctctgtgtagttccagcaaatcaagctgagctttgaaaaagtttgtcttagttttgtgaaggtgatttattcttaaaaaaaaaaaaaaaaaaaaaa

SEQ ID NO: 202 - DNA, 4249 bp, Homo sapiens
gcggcgcgcggggactcggaggtactgggcgcgcgcggctccggctcgggacgcctcgggacgcctcggggtcgggctccggctgcggctgctgctgcggcgcccgcgctccggtgcgctccgcctcctgtgcccgccgcggagcgcagtctgcgcgcccgccgtgcgccctcagctccttttcctgagcccgccgcgatgggagctgcgcggggatccccggccagaccccgccggttgcctctgctcagcgtcctgctgctgccgctgctgggcggtacccagacagccattgtcttcatcaagcagccgtcctcccaggatgcactgcaggggcgccgggcgctgcttcgctgtgaggttgaggctccgggcccggtacatgtgtactggctgctcgatggggcccctgtccaggacacggagcggcgtttcgcccagggcagcagcctgagctttgcagctgtggaccggctgcaggactctggcaccttccagtgtgtggctcgggatgatgtcactggagaagaagcccgcagtgccaacgcctccttcaacatcaaatggattgaggcaggtcctgtggtcctgaagcatccagcctcggaagctgagatccagccacagacccaggtcacacttcgttgccacattgatgggcaccctcggcccacctaccaatggttccgagatgggacccccctttctgatggtcagagcaaccacacagtcagcagcaaggagcggaacctgacgctccggccagctggtcctgagcatagtgggctgtattcctgctgcgcccacagtgcttttggccaggcttgcagcagccagaacttcaccttgagcattgctgatgaaagctttgccagggtggtgctggcaccccaggacgtggtagtagcgaggtatgaggaggccatgttccattgccagttctcagcccagccacccccgagcctgcagtggctctttgaggatgagactcccatcactaaccgcagtcgccccccacacctccgcagagccacagtgtttgccaacgggtctctgctgctgacccaggtccggccacgcaatgcagggatctaccgctgcattggccaggggcagaggggcccacccatcatcctggaagccacacttcacctagcagagattgaagacatgccgctatttgagccacgggtgtttacagctggcagcgaggagcgtgtgacctgccttccccccaagggtctgccagagcccagcgtgtggtgggagcacgcgggagtccggctgcccacccatggcagggtctaccagaagggccacgagctggtgttggccaatattgctgaaagtgatgctggtgtctacacctgccacgcggccaacctggctggtcagcggagacaggatgtcaacatcactgtggccactgtgccctcctggctgaagaagccccaagacagccagctggaggagggcaaacccggctacttggattgcctgacccaggccacaccaaaacctacagttgtctggtacagaaaccagatgctcatctcagaggactcacggttcgaggtcttcaagaatgggaccttgcgcatcaacagcgtggaggtgtatgatgggacatggtaccgttgtatgagcagcaccccagccggcagcatcgaggcgcaagcccgtgtccaagtgctggaaaagctcaagttcacaccaccaccccagccacagcagtgcatggagtttgacaaggaggccacggtgccctgttcagccacaggccgagagaagcccactattaagtgggaacgggcagatgggagcagcctcccagagtgggtgacagacaacgctgggaccctgcattttgcccgggtgactcgagatgacgctggcaactacacttgcattgcctccaacgggccgcagggccagattcgtgcccatgtccagctcactgtggcagtttttatcaccttcaaagtggaaccagagcgtacgactgtgtaccagggccacacagccctactgcagtgcgaggcccagggggaccccaagccgctgattcagtggaaaggcaaggaccgcatcctggaccccaccaagctgggacccaggatgcacatcttccagaatggctccctggtgatccatgacgtggcccctgaggactcaggccgctacacctgcattgcaggcaacagctgcaacatcaagcacacggaggcccccctctatgtcgtggacaagcctgtgccggaggagtcggagggccctggcagccctcccccctacaagatgatccagaccattgggttgtcggtgggtgccgctgtggcctacatcattgccgtgctgggcctcatgttctactgcaagaagcgctgcaaagccaagcggctgcagaagcagcccgagggcgaggagccagagatggaatgcctcaacggtgggcctttgcagaacgggcagccctcagcagagatccaagaagaagtggccttgaccagcttgggctccggccccgcggccaccaacaaacgccacagcacaagtgataagatgcacttcccacggtctagcctgcagcccatcaccacgctggggaagagtgagtttggggaggtgttcctggcaaaggctcagggcttggaggagggagtggcagagaccctggtacttgtgaagagcctgcagagcaaggatgagcagcagcagctggacttccggagggagttggagatgtttgggaagctgaaccacgccaacgtggtgcggctcctggggctgtgccgggaggctgagccccactacatggtgctggaatatgtggatctgggagacctcaagcagttcctgaggatttccaagagcaaggatgaaaaattgaagtcacagcccctcagcaccaagcagaaggtggccctatgcacccaggtagccctgggcatggagcacctgtccaacaaccgctttgtgcataaggacttggctgcgcgtaactgcctggtcagtgcccagagacaagtgaaggtgtctgccctgggcctcagcaaggatgtgtacaacagtgagtactaccacttccgccaggcctgggtgccgctgcgctggatgtcccccgaggccatcctggagggtgacttctctaccaagtctgatgtctgggccttcggtgtgctgatgtgggaagtgtttacacatggagagatgccccatggtgggcaggcagatgatgaagtactggcagatttgcaggctgggaaggctagacttcctcagcccgagggctgcccttccaaactctatcggctgatgcagcgctgctgggccctcagccccaaggaccggccctccttcagtgagattgccagcgccctgggagacagcaccgtggacagcaagccgtgaggagggagcccgctcaggatggcctgggcaggggaggacatctctagagggaagctcacagcatgatgggcaagatccctgtcctcctgggccctgaggcccctgccctagtgcaacaggcattgctgaggtctgagcagggcctggcctttcctcctcttcctcaccctcatcctttgggaggctgacttggacccaaactgggcgactagggctttgagctgggcagttttccctgccacctcttcctctatcagggacagtgtgggtgccacaggtaaccccaatttctggccttcaacttctccccttgaccgggtccaactctgccactcatctgccaactttgcctggggagggctaggcttgggatgagctgggtttgtggggagttccttaatattctcaagttctgggcacacagggttaatgagtctcttggcccactggtcccacttgggggtctagaccaggattatagaggacacagcaagtgagtcctccccactctgggcttgtgcacactgacccagacccacgtcttccccacccttctctcctttcctcatcctaagtgcctggcagatgaaggagttttcaggagcttttgacactatataaaccgccctttttgtatgcaccacgggcggcttttatatgtaattgcagcgtggggtgggtgggcatgggaggtaggggtgggccctggagatgaggagggtgggccatccttaccccacacttttattgttgtcgttttttgtttgttttgtttttttgtttttgtttttgtttttacactcgctgctctcaataaataagccttttttacaacctg

SEQ ID NO: 203 - DNA, 4541 bp, Homo sapiens
ggatcctctagggtcccagctcgcctcgatggagctcctcccgccgctgcctcagtccttcctgttgctgctgctgttgcctgccaagcccgcggcgggcgaggactggcagtgcccgcgcaccccctacgcggcctctcgcgactttgacgtgaagtacgtggtgcccagcttctccgccggaggcctggtacaggccatggtgacctacgagggcgacagaaatgagagtgctgtgtttgtagccatacgcaatcgcctgcatgtgcttgggcctgacctgaagtctgtccagagcctggccacgggccctgctggagaccctggctgccagacgtgtgcagcctgtggcccaggaccccacggccctcccggtgacacagacacaaaggtgctggtgctggatcccgcgctgcctgcgctggtcagttgtggctccagcctgcagggccgctgcttcctgcatgacctagagccccaagggacagccgtgcatctggcagcgccagcctgcctcttctcagcccaccataaccggcccgatgactgccccgactgtgtggccagcccattgggcacccgtgtaactgtggttgagcaaggccaggcctcctatttctacgtggcatcctcactggacgcagccgtggctggcagcttcagcccacgctcagtgtctatcaggcgtctcaaggctgacgcctcgggattcgcaccgggctttgtggcgttgtcagtgctgcccaagcatcttgtctcctacagtattgaatacgtgcacagcttccacacgggagccttcgtatacttcctgactgtacagccggccagcgtgacagatgatcctagtgccctgcacacacgcctggcacggcttagcgccactgagccagagttgggtgactatcgggagctggtcctcgactgcagatttgctccaaaacgcaggcgccggggggccccagaaggcggacagccctaccctgtgctgcaggtggcccactccgctccagtgggtgcccaacttgccactgagctgagcatcgccgagggccaggaagtactatttggggtctttgtgactggcaaggatggtggtcctggcgtgggccccaactctgtcgtctgtgccttccccattgacctgctggacacactaattgatgagggtgtggagcgctgttgtgaatccccagtccatccaggcctccggcgaggcctcgacttcttccagtcgcccagtttttgccccaacccgcctggcctggaagccctcagccccaacaccagctgccgccacttccctctgctggtcagtagcagcttctcacgtgtggacctattcaatgggctgttgggaccagtacaggtcactgcattgtatgtgacacgccttgacaacgtcacagtggcacacatgggcacaatggatgggcgtatcctgcaggtggagctggtcaggtcactaaactacttgctgtatgtgtccaacttctcactgggtgacagtgggcagcccgtgcagcgggatgtcagtcgtcttggggaccacctactctttgcctctggggaccaggttttccaggtacctatccgaggccctggctgccgccacttcctgacctgtgggcgttgcctaagggcatggcatttcatgggctgtggctggtgtgggaacatgtgcggccagcagaaggagtgtcctggctcctggcaacaggaccactgcccacctaagcttactgagttccacccccacagtggacctctaaggggcagtacaaggctgaccctgtgtggctccaacttctaccttcacccttctggtctggtgcctgagggaacccatcaggtcactgtgggccaaagtccctgccggccactgcccaaggacagctcaaaactcagaccagtgccccggaaagactttgtagaggagtttgagtgtgaactggagcccttgggcacccaggcagtggggcctaccaacgtcagcctcaccgtgactaacatgccaccgggcaagcacttccgggtagacggcacctccgtgctgagaggcttctctttcatggagccagtgctgatagcagtgcaacccctctttggcccacgggcaggaggcacctgtctcactcttgaaggccagagtctgtctgtaggcaccagccgggctgtgctggtcaatgggactgagtgtctgctagcacgggtcagtgaggggcagcttttatgtgccacaccccctggggccacggtggccagtgtcccccttagcctgcaggtggggggtgcccaggtacctggttcctggaccttccagtacagagaagaccctgtcgtgctaagcatcagccccaactgtggctacatcaactcccacatcaccatctgtggccagcatctaacttcagcatggcacttagtgctgtcattccatgacgggcttagggcagtggaaagcaggtgtgagaggcagcttccagagcagcagctgtgccgccttcctgaatatgtggtccgagacccccagggatgggtggcagggaatctgagtgcccgaggggatggagctgctggctttacactgcctggctttcgcttcctacccccaccccatccacccagtgccaacctagttccactgaagcctgaggagcatgccattaagtttgagtatattgggctgggcgctgtggctgactgtgtgggtatcaacgtgaccgtgggtggtgagagctgccagcacgagttccggggggacatggttgtctgccccctgcccccatccctgcagcttggccaggatggtgccccattgcaggtctgcgtagatggtgaatgtcatatcctgggtagagtggtgcggccagggccagatggggtcccacagagcacgctccttggtatcctgctgcctttgctgctgcttgtggctgcactggcgactgcactggtcttcagctactggtggcggaggaagcagctagttcttcctcccaacctgaatgacctggcatccctggaccagactgctggagccacacccctgcctattctgtactcgggctctgactacagaagtggccttgcactccctgccattgatggtctggattccaccacttgtgtccatggagcatccttctccgatagtgaagatgaatcctgtgtgccactgctgcggaaagagtccatccagctaagggacctggactctgcgctcttggctgaggtcaaggatgtgctgattccccatgagcgggtggtcacccacagtgaccgagtcattggcaaaggccactttggagttgtctaccacggagaatacatagaccaggcccagaatcgaatccaatgtgccatcaagtcactaagtcgcatcacagagatgcagcaggtggaggccttcctgcgagaggggctgctcatgcgtggcctgaaccacccgaatgtgctggctctcattggtatcatgttgccacctgagggcctgccccatgtgctgctgccctatatgtgccacggtgacctgctccagttcatccgctcacctcagcggaaccccaccgtgaaggacctcatcagctttggcctgcaggtagcccgcggcatggagtacctggcagagcagaagtttgtgcacagggacctggctgcgcggaactgcatgctggacgagtcattcacagtcaaggtggctgactttggtttggcccgcgacatcctggacagggagtactatagtgttcaacagcatcgccacgctcgcctacctgtgaagtggatggcgctggagagcctgcagacctatagatttaccaccaagtctgatgtgtggtcatttggtgtgctgctgtgggaactgctgacacggggtgccccaccataccgccacattgacccttttgaccttacccacttcctggcccagggtcggcgcctgccccagcctgagtattgccctgattctctgtaccaagtgatgcagcaatgctgggaggcagacccagcagtgcgacccaccttcagagtactagtgggggaggtggagcagatagtgtctgcactgcttggggaccattatgtgcagctgccagcaacctacatgaacttgggccccagcacctcgcatgagatgaatgtgcgtccagaacagccgcagttctcacccatgccagggaatgtacgccggccccggccactctcagagcctcctcggcccacttgacttagttcttgggctggacctgcttagctgccttgagctaaccccaaggctgcctctgggccatgccaggccagagcagtggccctccaccttgttcctgccctttaactttcagaggcaataggtaaatgggcccattaggtccctcactccacagagtgagccagtgagggcagtcctgcaacatgtatttatggagtgcctgctgtggaccctgtcttctgggcacagtggactcagcagtgaccacaccaacactgacccttgaaccaataaaggaacaaatgactattaaagcacaaaaaaaaaa

The invention claimed is:

1. A method of diagnosing lung cancer in a subject, the method comprising detecting a higher level of Na-K ATPase beta3 protein in a sample from the subject's lung as compared to the level of Na-K ATPase beta3 protein in samples from healthy subject's lungs, wherein the higher level of Na-K ATPase beta3 protein indicates that said subject has lung cancer, and wherein the amino acid sequence of the Na-K ATPase beta3 protein comprises a sequence selected from group consisting of SEQ ID NOS:127-134.

2. The method of claim 1, wherein the higher level of Na-K ATPase beta3 protein is detected by contacting the sample with an isolated antibody that selectively binds to the Na-K ATPase beta3 protein and determining the extent of binding of the antibody to the Na-K ATPase beta3 protein.

3. The method of claim 2, wherein the antibody is coupled to a detectable substance.

* * * * *